(12) United States Patent
Bindel

(10) Patent No.: US 9,365,875 B2
(45) Date of Patent: Jun. 14, 2016

(54) 3-HYDROXYPROPIONIC ACID PRODUCTION BY RECOMBINANT YEASTS

(71) Applicant: Novozymes, Inc., Davis, CA (US)

(72) Inventor: Mariah Bindel, Sacramento, CA (US)

(73) Assignee: NOVOZYMES, INC., Davis, CA (US)

( * ) Notice: Subject to any disclaimer, the term of this patent is extended or adjusted under 35 U.S.C. 154(b) by 0 days.

(21) Appl. No.: 14/089,219

(22) Filed: Nov. 25, 2013

(65) Prior Publication Data

US 2014/0154760 A1    Jun. 5, 2014

Related U.S. Application Data

(60) Provisional application No. 61/731,722, filed on Nov. 30, 2012.

(51) Int. Cl.
| | | |
|---|---|---|
| *C12P 7/42* | (2006.01) | |
| *C12N 1/16* | (2006.01) | |
| *C12N 9/02* | (2006.01) | |
| *C12N 15/52* | (2006.01) | |

(52) U.S. Cl.
CPC ... *C12P 7/42* (2013.01); *C12N 1/16* (2013.01); *C12N 9/0008* (2013.01); *C12N 15/52* (2013.01); *C12Y 102/01009* (2013.01); *Y02P 20/52* (2015.11)

(58) Field of Classification Search
None
See application file for complete search history.

(56) References Cited

U.S. PATENT DOCUMENTS

| | | |
|---|---|---|
| 6,455,284 B1 | 9/2002 | Gokarn et al. |
| 2005/0106734 A1 | 5/2005 | Richard et al. |
| 2007/0107080 A1 | 5/2007 | Liao et al. |
| 2009/0325248 A1 | 12/2009 | Marx et al. |
| 2010/0009418 A1 | 1/2010 | San et al. |
| 2010/0021978 A1 | 1/2010 | Burk et al. |
| 2011/0144377 A1 | 6/2011 | Eliot et al. |
| 2011/0244575 A1* | 10/2011 | Lipscomb et al. ............ 435/471 |
| 2012/0135481 A1 | 5/2012 | Jessen et al. |
| 2012/0244588 A1 | 9/2012 | Park et al. |
| 2012/0329110 A1 | 12/2012 | Kim et al. |
| 2013/0224804 A1 | 8/2013 | Knight |
| 2014/0342414 A1* | 11/2014 | Valle et al. .................... 435/136 |

FOREIGN PATENT DOCUMENTS

| | | |
|---|---|---|
| EP | 1073722 B1 | 4/1999 |
| EP | 2194122 A1 | 4/1999 |
| EP | 2505656 A1 | 10/2012 |
| WO | 0116346 A1 | 3/2001 |
| WO | 0242418 A2 | 5/2002 |
| WO | 03038067 A1 | 5/2003 |

(Continued)

OTHER PUBLICATIONS

Yao et al., "The catalytic property of 3-hydroxyisobutyrate dehydrogenase from Bacillus cereus on 3-hydroxypropionate", Applied Biochemistry and Biotechnology, vol. 160, pp. 694-703, 2010.*

(Continued)

*Primary Examiner* — Robert Mondesi
*Assistant Examiner* — Richard Ekstrom
(74) *Attorney, Agent, or Firm* — Eric Fechter

(57) ABSTRACT

Provided herein are recombinant yeast cells having an active 3-Hydroxypropionic Acid (3-HP) pathway and further comprising a heterologous polynucleotide encoding a non-phosphorylating NADP-dependent glyceraldehyde-3-phosphate dehydrogenase (GAPN). Also described are methods of using the recombinant yeast cells to produce 3-HP and acrylic acid.

27 Claims, 21 Drawing Sheets

(56) References Cited

FOREIGN PATENT DOCUMENTS

| WO | 03062173 | A2 | 7/2003 |
|---|---|---|---|
| WO | 03082795 | A2 | 10/2003 |
| WO | 2004048559 | A1 | 6/2004 |
| WO | 2005118719 | A2 | 12/2005 |
| WO | 2006022664 | A2 | 3/2006 |
| WO | 2006047589 | A2 | 5/2006 |
| WO | 2007106524 | A2 | 9/2007 |
| WO | 2008027742 | A1 | 3/2008 |
| WO | 2008089102 | A2 | 7/2008 |
| WO | 2008091627 | A2 | 7/2008 |
| WO | 2009089457 | A1 | 7/2009 |
| WO | 2010011874 | A2 | 1/2010 |
| WO | 2010031083 | A2 | 3/2010 |
| WO | 2011038364 | A1 | 3/2011 |
| WO | 2011094457 | A1 | 8/2011 |
| WO | 2012074818 | A2 | 6/2012 |
| WO | 2012129450 | A1 | 9/2012 |
| WO | 2013043758 | A2 | 3/2013 |

OTHER PUBLICATIONS

Guo et al., "Protein tolerance to random amino acid change", Proceedings of the National Academy of Sciences USA, vol. 101, No. 25, pp. 9205-9210, 2004.*
GenBank Accession No. AAD28430.1, published May 2, 1999.*
GenBank Accession No. ACG33671.1, published Dec. 10, 2008.*
Andersen et al, 2008, J Mol Biol 380 (4), 656-666.
Jiang et al, 2009, Appl Microbiol Biotec 82 (6), 995-1003.
Alber et al, 2006, J Bacteriol 188(24), 8551-8559.
Boyd et al, 1995, J Bacteriol 177(10), 2622-2727.
Bro et al, 2006, Metabolic Engineering 8, 102-111.
Guo et al, 2011, J Ind Microbiol Biotechnol 38, 935-943.
Guo et al, 2011, Metabolic Engineering 13, 49-59.
Habenicht et al, 1995, J Mol Biol 237, 165-171.
Henry et al, 2010, Biotechnol Bioeng 106(3), 462-473.
Iddar et al, 2005, Int Microbiol 8, 251-258.
Khoury et al, 2009, Protein Science 18, 2125-2138.
Marrtinez et al, 2008, Metabolic Engineering 10, 352-359.
Myers et al, 1983, Biochemistry 22, 5090-5096.
Richter et al, 2011, Eng Life Sci 11(1), 26-36.
Sauer et al, 2005, FEMS Micro Rev 29, 765-794.
Straathof et al, 2005, Appl Microbiol Biotechnol 67, 727-734.
Takeno et al, 2010, Appl Environ Microbiol 76(21), 7154-7160.
Valverde et al, 1999, FEBS 449, 153-158.
Yamazawa et al, 2011, J Biochem 149(6), 701-712.
Van Maris et al, 2004, Appl Envir Microbiol 70(1), 159-166.
Tamoi et al., 1996, Biochem J, 316, 685-690.
Van Maris et al 2004 Met Eng 6 245-255.

* cited by examiner

1. Glyceraldehyde-3-phosphate dehydrogenase (NADP+; non-phosphorylating)
   (GAPN; EC 1.2.1.9)
2. Glyceraldehyde-3-phosphate dehydrogenase (phosphorylating)
   (GAPDH; EC 1.2.1.12)
3. Glyceraldehyde-3-phosphate dehydrogenase (NADP+; phosphorylating)
   (GAPDH; EC 1.2.1.13)
4. Phosphoglycerate kinase
   (PKG; EC 2.7.2.3)

3-HYDROXYPROPIONIC ACID PRODUCTION BY RECOMBINANT YEASTS

CROSS-REFERENCE TO RELATED APPLICATIONS

This application claims priority from U.S. provisional application Ser. No. 61/731,722, filed on Nov. 30, 2012, the content of which is fully incorporated herein by reference.

REFERENCE TO A SEQUENCE LISTING

This application contains a Sequence Listing in computer readable form, which is incorporated herein by reference.

BACKGROUND

Concerns related to future supply of oil have prompted research in the area of renewable energy and renewable sources of other raw materials. Biofuels, such as ethanol and bioplastics (e.g., polylactic acid) are examples of products that can be made directly from agricultural sources using microorganisms. Additional desired products may then be derived using non-enzymatic chemical conversions, e.g., dehydration of ethanol to ethylene.

3-hydroxypropionic acid (3-HP) is a three carbon carboxylic acid identified by the U.S. Department of Energy as one of the top 12 high-potential building block chemicals that can be made by fermentation. Alternative names for 3-HP, which is an isomer of lactic (2-hydroxypropionic) acid, include ethylene lactic acid and 3-hydroxypropionate. 3-HP is an attractive renewable platform chemical, with 100% theoretical yield from glucose, multiple functional groups that allow it to participate in a variety of chemical reactions, and low toxicity. 3-HP can be used as a substrate to form several commodity chemicals, such as 1,3-propanediol, malonic acid, acrylamide, and acrylic acid. Acrylic acid is a large-volume chemical (>7 billion lbs/year) used to make acrylate esters and superabsorbent polymers, and is currently derived from catalytic oxidation of propylene. Fermentative production of 3-HP would provide a sustainable alternative to petrochemicals as the feedstock for these commercially-significant chemicals, thus reducing energy consumption, US dependence on foreign oil, and the production of greenhouse gases.

Bacteria can be used to ferment sugars to organic acids. However, bacteria present certain drawbacks for large-scale organic acid production. As organic acids are produced, the fermentation medium becomes increasingly acidic. Lower pH conditions are actually preferable, because the resultant product is partially or wholly in the acid form. However, most bacteria that produce organic acids do not perform well in strongly acidic environments, and therefore either die or begin producing so slowly that they become economically unviable as the medium becomes more acidic. To prevent this, it becomes necessary to buffer the medium to maintain a higher pH. However, this makes recovery of the organic acid product more difficult and expensive.

There has been increasing interest in recent years around the use of yeast to ferment sugars to organic acids. Yeasts are used as biocatalysts in a number of industrial fermentations, and present several advantages over bacteria. While many bacteria are unable to synthesize certain amino acids or proteins that they need to grow and metabolize sugars efficiently, most yeast species can synthesize their necessary amino acids or proteins from inorganic nitrogen compounds. Yeasts are also not susceptible to bacteriophage infection, which can lead to loss of productivity or of whole fermentation runs in bacteria.

Although yeasts are attractive candidates for organic acid production, they present several difficulties. First, pathway engineering in yeast is typically more difficult than in bacteria. Enzymes in yeast are compartmentalized in the cytoplasm, mitochondria, or peroxisomes, whereas in bacteria they are pooled in the cytoplasm. This means that targeting signals may need to be removed to ensure that all the enzymes of the biosynthetic pathway co-exist in the same compartment within a single cell. Control of transport of pathway intermediates between the compartments may also be necessary to maximize carbon flow to the desired product. Second, not all yeast species meet the necessary criteria for economic fermentation on a large scale. In fact, only a small percentage of yeasts possess the combination of sufficiently high volumetric and specific sugar utilization with the ability to grow robustly under low pH conditions. The U.S. Department of Energy has estimated that production rates of approximately 2.5 g/L/hour are necessary for economic fermentations of several organic acids, including 3-HP (http://www1.eere.energy.gov/biomass/pdfs/35523.pdf).

Although many yeast species naturally ferment hexose sugars to ethanol, few if any naturally produce significant yields of organic acids. This has led to efforts to genetically modify various yeast species to produce organic acids. Genetically modified yeast strains that produce lactic acid have been previously developed by disrupting or the endogenous pyruvate decarboxylase (PDC) gene and inserting a lactate dehydrogenase (LDH) gene to eliminate ethanol production (see, e.g., WO99/14335, WO00/71738, WO02/42471, WO03/049525, WO03/102152 and WO03/102201). This alteration diverts sugar metabolism from ethanol production to lactic acid production. The fermentation products and pathways for yeast differ from those of bacteria, and thus different engineering approaches are necessary to maximize yield. Other native products that may require elimination or reduction in order to enhance organic acid product yield or purity are glycerol, acetate, and diols. The reduction of glycerol in genetically altered yeast strains is described in, for example, WO07/106524.

Unlike lactic acid, 3-HP is not a major end product of any pathway known in nature, being found in only trace amounts in some bacteria and fungi. Thus, a greater deal of genetic engineering is necessary to generate yeast that produce 3-HP. A *Saccharomyces cerevisiae* strain was previously engineered to produce 3-HP at very low levels through a lactate intermediate (see WO02/042418). However, the tolerance level of wild-type *S. cerevisiae* is insufficient to make it an optimal host for 3-HP production. Yeast cells that are highly tolerant to 3-HP are described in US2012/0135481. However, there is still a need in the art to further improve 3-HP production in a more cost-effective manner on an industrial scale.

SUMMARY

Described herein are recombinant yeast cells having an active 3-HP pathway, wherein the pathway comprises non-phosphorylating NADP-dependent glyceraldehyde-3-phosphate dehydrogenase (GAPN) activity. In some aspects, the recombinant yeast cells comprise a heterologous polynucleotide encoding a non-phosphorylating NADP-dependent glyceraldehyde-3-phosphate dehydrogenase (GAPN).

In one aspect is a recombinant yeast cell comprising (1) an active 3-HP pathway that proceeds through a β-alanine intermediate, and (2) a heterologous polynucleotide encoding a non-phosphorylating NADP-dependent glyceraldehyde-3-phosphate dehydrogenase (GAPN), wherein the cell capable of producing 3-HP. In some embodiments, the cell comprises a heterologous polynucleotide encoding an aspartate 1-decarboxylase (ADC). In some embodiments, the GAPN has at least 50% sequence identity to the amino acid sequence of SEQ ID NO: 154, 155, 156, 157, 158, 159, 160, 161, 162, 189, 190, 192, or 194.

In another aspect is a recombinant yeast cell, comprising (1) an active 3-HP pathway, and (2) a heterologous polynucleotide encoding a non-phosphorylating NADP-dependent glyceraldehyde-3-phosphate dehydrogenase (GAPN), wherein the GAPN has: (a) at least 50% sequence identity to the amino acid sequence of SEQ ID NO: 192; or (b) at least 80% sequence identity to the amino acid sequence of SEQ ID NO: 194; and wherein the cell is capable of producing 3-HP.

In some aspects, the recombinant yeast cells produce a greater amount of 3-HP compared to the cells without the heterologous polynucleotide encoding the non-phosphorylating NADP-dependent glyceraldehyde-3-phosphate dehydrogenase (GAPN) when cultivated under identical conditions.

In some aspects, the recombinant yeast cells comprise one or more (e.g., two, several) heterologous polynucleotides selected from a heterologous polynucleotide encoding a PPC, a heterologous polynucleotide encoding a PYC, a heterologous polynucleotide encoding an AAT, a heterologous polynucleotide encoding an ADC, a heterologous polynucleotide encoding a BAAT or gabT, and a heterologous polynucleotide encoding a 3-HPDH.

In some embodiments, the recombinant yeast cells comprise a disruption to one or more endogenous genes encoding a PDC, ADH, GAL6, CYB2A, CYB2B, GPD, GPP, ALD, or PCK. In some embodiments, the recombinant yeast cells comprise a disruption to one or both of an endogenous gene encoding a PDC and an endogenous gene encoding a GPD.

In some embodiments, the yeast cell is an *Issatchenkia, Candida, Kluyveromyces, Pichia, Schizosaccharomyces, Torulaspora, Zygosaccharomyces,* or *Saccharomyces* yeast cell. In some embodiments, the yeast cell is an *I. orientalis* CNB1 yeast cell. In some embodiments, the recombinant yeast cell is a 3-HP-resistant yeast cell. In some embodiments, the cell is unable to ferment pentose sugars.

Also described are methods of producing 3-HP and related compounds. In one aspect is a method of producing 3-HP, comprising: (a) cultivating a recombinant yeast cell described herein in a medium under suitable conditions to produce 3-HP; and (b) recovering the 3-HP. In another aspect is a method of producing acrylic acid or a salt thereof, comprising: (a) cultivating a recombinant yeast cell described herein in a medium under suitable conditions to produce 3-HP; (b) recovering the 3-HP; (c) dehydrating the 3-HP under suitable conditions to produce acrylic acid or a salt thereof; and (d) recovering the acrylic acid or salt thereof.

DEFINITIONS

Figure 1:
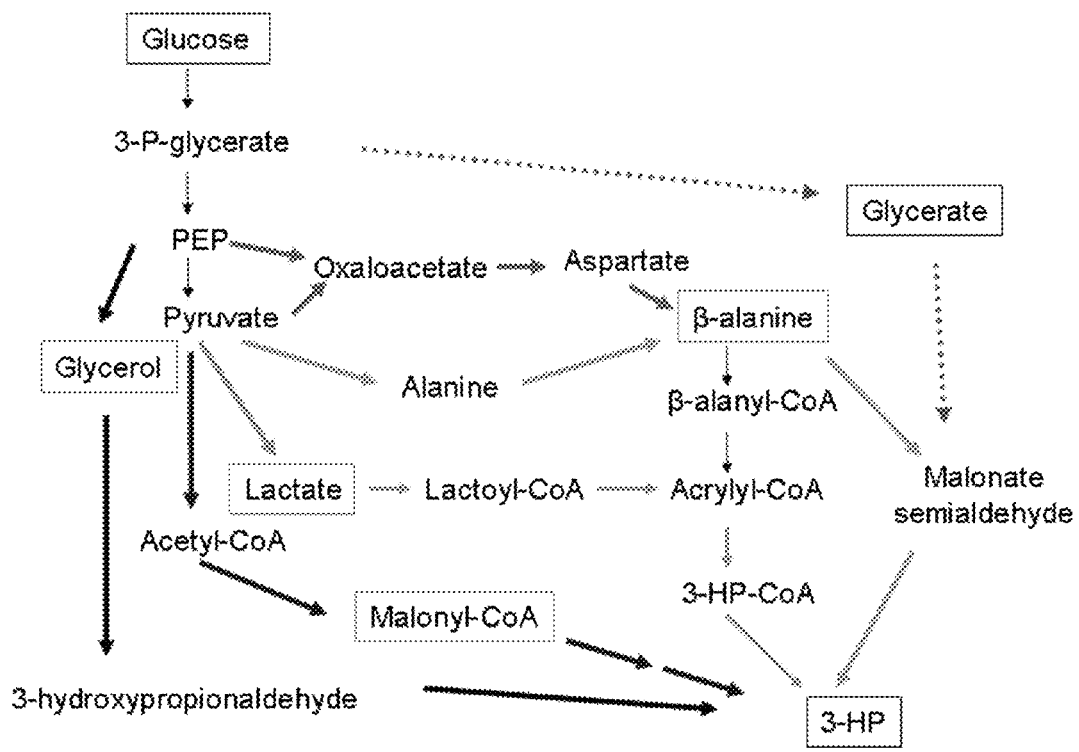
FIG. 1 shows a summary of select 3-HP pathways from glucose.

3-HP: The term "3-HP" includes salt and acid forms of "3-hydroxypropionic acid."

Active 3-HP pathway: As used herein, a host cell having an "active 3-HP pathway" produces active enzymes necessary to catalyze each reaction of a metabolic pathway in a sufficient amount to produce 3-HP from a fermentable sugar, and therefore is capable of producing 3-HP in measurable yields when cultivated under fermentation conditions in the presence of at least one fermentable sugar. A host cell having an active 3-HP pathway comprises one or more 3-HP pathway genes. A "3-HP pathway gene" as used herein refers to a gene that encodes an enzyme involved in an active 3-HP pathway.

The active enzymes necessary to catalyze each reaction in an active 3-HP pathway may result from activities of endogenous gene expression, activities of heterologous gene expression, or from a combination of activities of endogenous and heterologous gene expression, as described in more detail herein.

Non-phosphorylating NADP-dependent glyceraldehyde-3-phosphate dehydrogenase (GAPN): The term "non-phosphorylating NADP-dependent glyceraldehyde-3-phosphate dehydrogenase", "NADP-dependent glyceraldehyde-3-phosphate dehydrogenase" or "GAPN" is defined herein as an enzyme that catalyzes the chemical reaction of glyceraldehyde-3-phosphate and NADP+ to 3-phosphoglycerate and NADPH (e.g., EC 1.2.1.9). GAPN activity may be determined from cell-free extracts as described in the art, e.g., as described in Tamoi et al., 1996, Biochem. J. 316, 685-690; or as described in the Examples herein. For example, GAPN activity may be measured spectrophotometrically by monitoring the absorbance change following NADPH oxidation at 340 nm in a reaction mixture containing 100 mM Tris/HCl buffer (pH 8.0), 10 mM $MgCl_2$, 10 mM GSH, 5 mM ATP, 0.2 mM NADPH, 2 units of 3-phosphoglyceric phosphokinase, 2 mM 3-phosphoglyceric acid and the enzyme.

Disruption: The term "disruption" means that a coding region and/or control sequence of a referenced gene is partially or entirely modified (such as by deletion, insertion, and/or substitution of one or more nucleotides) resulting in the absence (inactivation) or decrease in expression, and/or the absence or decrease of enzyme activity of the encoded polypeptide. The effects of disruption can be measured using techniques known in the art such as detecting the absence or decrease of enzyme activity using from cell-free extract measurements referenced herein; or by the absence or decrease of corresponding mRNA (e.g., at least 25% decrease, at least 50% decrease, at least 60% decrease, at least 70% decrease, at least 80% decrease, or at least 90% decrease); the absence or decrease in the amount of corresponding polypeptide having enzyme activity (e.g., at least 25% decrease, at least 50% decrease, at least 60% decrease, at least 70% decrease, at least 80% decrease, or at least 90% decrease); or the absence or decrease of the specific activity of the corresponding polypeptide having enzyme activity (e.g., at least 25% decrease, at least 50% decrease, at least 60% decrease, at least 70% decrease, at least 80% decrease, or at least 90% decrease). Disruptions of a particular gene of interest can be generated by methods known in the art, e.g., by directed homologous recombination (see *Methods in Yeast Genetics* (1997 edition), Adams, Gottschling, Kaiser, and Stems, Cold Spring Harbor Press (1998)).

Coding sequence: The term "coding sequence" or "coding region" means a polynucleotide sequence, which specifies the amino acid sequence of a polypeptide. The boundaries of the coding sequence are generally determined by an open reading frame, which usually begins with the ATG start codon or alternative start codons such as GTG and TTG and ends with a stop codon such as TAA, TAG, and TGA. The coding sequence may be a sequence of genomic DNA, cDNA, a synthetic polynucleotide, and/or a recombinant polynucleotide.

Sequence Identity: The relatedness between two amino acid sequences or between two nucleotide sequences is described by the parameter "sequence identity".

For purposes described herein, the degree of sequence identity between two amino acid sequences is determined using the Needleman-Wunsch algorithm (Needleman and Wunsch, *J. Mol. Biol.* 1970, 48, 443-453) as implemented in the Needle program of the EMBOSS package (EMBOSS: The European Molecular Biology Open Software Suite, Rice et al., *Trends Genet* 2000, 16, 276-277), preferably version 3.0.0 or later. The optional parameters used are gap open penalty of 10, gap extension penalty of 0.5, and the EBLOSUM62 (EMBOSS version of BLOSUM62) substitution matrix. The output of Needle labeled "longest identity" (obtained using the -nobrief option) is used as the percent identity and is calculated as follows:

(Identical Residues×100)/(Length of the Referenced Sequence−Total Number of Gaps in Alignment)

For purposes described herein, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. The optional parameters used are gap open penalty of 10, gap extension penalty of 0.5, and the EDNAFULL (EMBOSS version of NCBI NUC4.4) substitution matrix. The output of Needle labeled "longest identity" (obtained using the -nobrief option) is used as the percent identity and is calculated as follows:

(Identical Deoxyribonucleotides×100)/(Length of Referenced Sequence−Total Number of Gaps in Alignment)

Heterologous polynucleotide: The term "heterologous polynucleotide" is defined herein as a polynucleotide that is not native to the host cell; a native polynucleotide in which structural modifications have been made to the coding region; a native polynucleotide whose expression is quantitatively altered as a result of a manipulation of the DNA by recombinant DNA techniques, e.g., a different (foreign) promoter; or a native polynucleotide in a host cell having one or more extra copies of the polynucleotide to quantitatively alter expression. A "heterologous gene" is a gene comprising a heterologous polynucleotide.

Endogenous gene: The term "endogenous gene" means a gene that is native to the referenced host cell. "Endogenous gene expression" means expression of an endogenous gene.

Nucleic acid construct: The term "nucleic acid construct" means a polynucleotide comprises one or more (e.g., two, several) control sequences. The polynucleotide may be single-stranded or double-stranded, and may be isolated from a naturally occurring gene, modified to contain segments of nucleic acids in a manner that would not otherwise exist in nature, or synthetic.

Control sequence: The term "control sequence" means a nucleic acid sequence necessary for polypeptide expression. Control sequences may be native or foreign to the polynucleotide encoding the polypeptide, and native or foreign to each other. Such control sequences include, but are not limited to, a leader sequence, polyadenylation sequence, propeptide sequence, promoter sequence, signal peptide sequence, and transcription terminator sequence. The control sequences may be provided with linkers for the purpose of introducing specific restriction sites facilitating ligation of the control sequences with the coding region of the polynucleotide encoding a polypeptide.

Operably linked: The term "operably linked" means a configuration in which a control sequence is placed at an appropriate position relative to the coding sequence of a polynucleotide such that the control sequence directs expression of the coding sequence.

Expression: The term "expression" includes any step involved in the production of the polypeptide including, but not limited to, transcription, post-transcriptional modification, translation, post-translational modification, and secretion. Expression can be measured—for example, to detect increased expression—by techniques known in the art, such as measuring levels of mRNA and/or translated polypeptide.

Expression vector: The term "expression vector" means a linear or circular DNA molecule that comprises a polynucleotide encoding a polypeptide and is operably linked to control sequences, wherein the control sequences provide for expression of the polynucleotide encoding the polypeptide. At a minimum, the expression vector comprises a promoter sequence, and transcriptional and translational stop signal sequences.

Host cell: The term "host cell" means any cell type that is susceptible to transformation, transfection, transduction, and the like with a nucleic acid construct or expression vector. The term "host cell" encompasses any progeny of a parent cell that is not identical to the parent cell due to mutations that occur during replication. The term "recombinant yeast cell" is defined herein as a non-naturally occurring yeast host cell comprising one or more (e.g., two, several) heterologous polynucleotides.

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Volumetric productivity: The term "volumetric productivity" refers to the amount of referenced product produced (e.g., the amount of 3-HP produced) per volume of the system used (e.g., the total volume of media and contents therein) per unit of time.

Fermentable medium: The term "fermentable medium" or "fermentation medium" refers to a medium comprising one or more (e.g., two, several) sugars, such as glucose, fructose, sucrose, cellobiose, xylose, xylulose, arabinose, mannose, galactose, and/or soluble oligosaccharides, wherein the medium is capable, in part, of being converted (fermented) by a host cell into a desired product, such as 3-HP. In some instances, the fermentation medium is derived from a natural source, such as sugar cane, starch, or cellulose, and may be the result of pretreating the source by enzymatic hydrolysis (saccharification).

High stringency conditions: The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 65° C.

Low stringency conditions: The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 50° C.

Medium stringency conditions: The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 55° C.

Medium-high stringency conditions: The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 0.2×SSC, 0.2% SDS at 60° C.

Very high stringency conditions: The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.2×SSC, 0.2% SDS at 70° C.

Very low stringency conditions: The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 0.2×SSC, 0.2% SDS at 45° C.

Abbreviations: 3-HPA, 3-hydroxypropionaldehyde; 3-HPDH, 3-hydroxypropionic acid dehydrogenase; AAM, alanine 2,3 aminomutase; AAT, aspartate aminotransferase; ACC, acetyl-CoA carboxylase; ADC, aspartate 1-decarboxylase; AKG, alpha-ketoglutarate; ALD, aldehyde dehydrogenase; BAAT, β-alanine aminotransferase; BCKA, branched-chain alpha-keto acid decarboxylase; bp, base pairs; CYB2, L-(+)-lactate-cytochrome c oxidoreductase; CYC, iso-2-cytochrome c; EMS, ethane methyl sulfonase; ENO, enolase; gabT, 4-aminobutyrate aminotransferase; GAPDH, glyceraldehyde-3-phosphate dehydrogenase 3; GPD, glycerol 3-phosphate dehydrogenase; GPP, glycerol 3-phosphate phosphatase; HIBADH, 3-hydroxyisobutyrate dehydrogenase; IPDA, indolepyruvate decarboxylase; KGD, alpha-ketoglutarate decarboxylase; LDH, lactate dehydrogenase; MAE, malic enzyme; OAA, oxaloacetate; PCK, phosphoenolpyruvate carboxykinase; PDC, pyruvate decarboxylase; PDH, pyruvate dehydrogenase; PEP, phosphoenolpyruvate; PGK, phosphoglycerate kinase; PPC, phosphoenolpyruvate carboxylase; PYC, pyruvate carboxylase; RKI, ribose 5-phosphate ketol-isomerase; TAL, transaldolase; TEF1, translation elongation factor-1; TEF2, translation elongation factor-2; TKL, transketolase; XDH, xylitol dehydrogenase; XR, xylose reductase; YP, yeast extract/peptone.

Reference to "about" a value or parameter herein includes aspects that are directed to that value or parameter per se. For example, description referring to "about X" includes the aspect "X". When used in combination with measured values, "about" includes a range that encompasses at least the uncertainty associated with the method of measuring the particular value, and can include a range of plus or minus two standard deviations around the stated value.

As used herein and in the appended claims, the singular forms "a," "or," and "the" include plural referents unless the context clearly dictates otherwise. It is understood that the aspects described herein include "consisting" and/or "consisting essentially of" aspects.

Unless defined otherwise or clearly indicated by context, all technical and scientific terms used herein have the same meaning as commonly understood by one of ordinary skill in the art.

DETAILED DESCRIPTION

Figure 2:
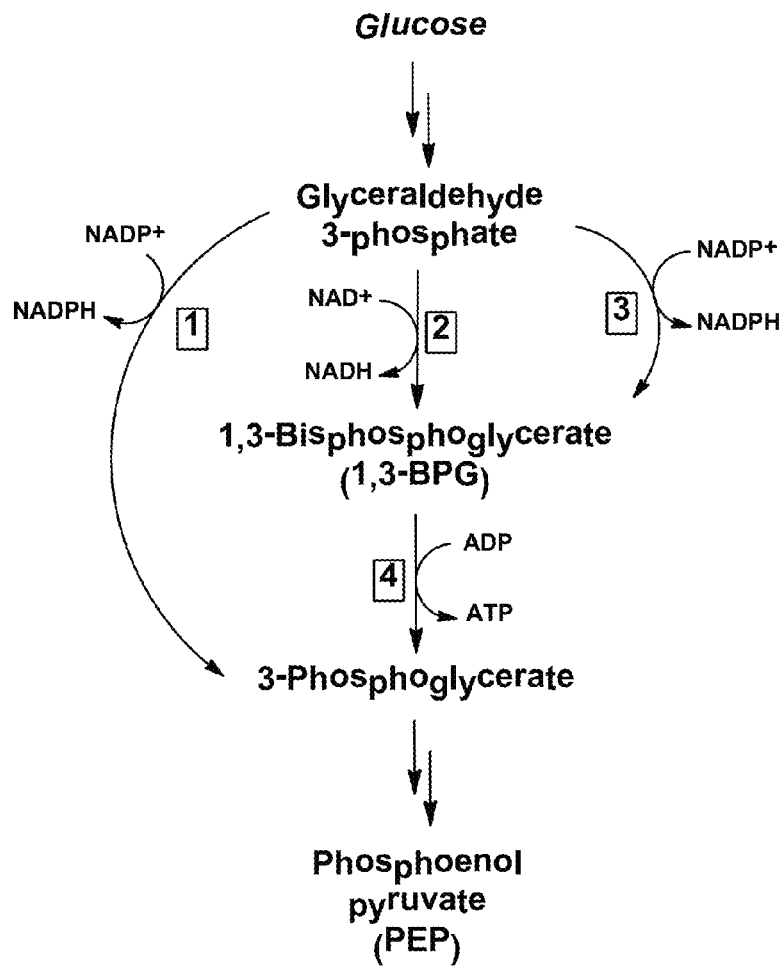
FIG. 2 shows a summary of pathways for the production of 3-phosphoglycerate.

Described herein, inter alia, are recombinant yeast cells having an active 3-HP pathway which further comprises a heterologous polynucleotide encoding a non-phosphorylating NADP-dependent glyceraldehyde-3-phosphate dehydrogenase (GAPN). Applicant has surprisingly found that expression of GAPN together with an active 3-HP pathway through β-alanine enhances the production of metabolic 3-HP compared to the cells without the heterologous polynucleotide encoding the GAPN. It is known that transport of 3-HP salt outside the cell is ATP consuming (van Maris et al. *Metabolic Engineering* 2004, 6, 245-255). Consequently, increased extracellular 3-HP in cells expressing GAPN is unexpected since GAPN bypasses the generation of ATP when producing 3-phosphoglycerate en route to pyruvate (see FIG. 2).

Applicant's finding of expressing GAPN to increase 3-HP production may be particularly applicable to yeast cells, which are believed to lack GAPN activity. Further, since GAPN produces NADPH rather than NADH (see FIG. 2), expressing GAPN may also be applicable to produce 3-HP in cells that could benefit from increased NADPH (e.g., cells that overexpress an enzyme that utilizes NADPH, such as 3-HPDHs of class EC 1.1.1.298) or cells that could benefit from decreased of NADH (e.g., cells that have disruptions to an endogenous GPD or PDC gene resulting in NADH buildup).

In one aspect, the recombinant yeast cell comprises a heterologous polynucleotide encoding a GAPN and produces (or is capable of producing) a greater amount of 3-HP compared to the yeast cell without the heterologous polynucleotide when cultivated under the same conditions. In some aspects, the yeast cell lacks an endogenous GAPN gene. In some embodiments, the yeast cell produces (or is capable of producing) at least 10% more (e.g., at least 15%, at least 20%, at least 25%, at least 30%, at least 35%, at least 40%, at least 45%, at least 50%, at least 75%, at least 100%, or at least 200% more) 3-HP compared to the cell without the heterologous polynucleotide encoding the GAPN, when cultivated under identical conditions.

Non-Phosphorylating NADP-Dependent Glyceraldehyde-3-Phosphate Dehydrogenases (GAPNs)

The non-phosphorylating NADP-dependent glyceraldehyde-3-phosphate dehydrogenase (GAPN) can be any GAPN that is suitable for the host cells and their methods of use described herein, such as a naturally occurring GAPN (e.g., an endogenous GAPN or a native GAPN from another species) or a variant thereof that retains GAPN activity. In one aspect, GAPN is present in the cytosol of the host cells.

In some aspects, the recombinant yeast cells comprising a heterologous polynucleotide encoding a GAPN have an increased level of GAPN activity compared to the host cells without the heterologous polynucleotide encoding the GAPN, when cultivated under the same conditions. In some aspects, the yeast cells have an increased level of GAPN activity of at least 5%, e.g., at least 10%, at least 15%, at least 20%, at least 25%, at least 50%, at least 100%, at least 150%, at least 200%, at least 300%, or at 500% compared to the host cells without the heterologous polynucleotide encoding the GAPN, when cultivated under the same conditions.

Exemplary GAPNs that may be used with the host cells and methods of use described herein include, but are not limited to, those GAPNs shown in Table 1.

TABLE 1

| Organism | Sequence Database | Sequence Code | SEQ ID NO |
| --- | --- | --- | --- |
| *Streptococcus mutans* | UniProtKB | Q59931 | 154 |
| *Sulfolobus solfataricus* | UniProtKB | Q97U30 | 189 |
| *Clostridium acetobutylicum* | NCBI | YP_005672796.1 | 190 |
| *Pisum sativum* | UniProtKB | P81406 | 155 |
| *Triticum aestivum* | UniProtKB | Q8LK61 | 156 |
| *Arabidopsis thaliana* | UniProtKB | Q1WIQ6 | 157 |
| *Streptococcus equinus* | UniProtKB | Q3C1A6 | 158 |
| *Zea mays* | UniProtKB | Q43272 | 159 |
|  |  | B4FR32 | 192 |
| *Scenedesmus vacuolatus* | UniProtKB | Q8VXQ7 | 160 |
| *Apium graveolens* | UniProtKB | Q9SNX8 | 161 |
| *Nicotiana plumbaginifolia* | UniProtKB | P93338 | 162 |
| *Lactobacillus delbrueckii* | UniProtKB | Q04A83 | 194 |

Additional polynucleotides encoding suitable GAPNs may be obtained from microorganisms of any suitable genus, including those readily available within the UniProtKB database (www.uniprot.org). In one aspect, the GAPN is a gram-positive bacterial GAPN, or a GAPN obtained from any of the microorganisms described herein, such a photosynthetic eukaryote, (including plants and green algae), or archaea.

For example, the GAPN may be obtained from any one of the species *Apium graveolens, Arabidopsis thaliana, Arachis hypogaea, Arum italicum, Bacillus cereus, Bacillus licheniformis, Bacillus thuringiensis, Beta vulgaris, Chlamydomonas reinhardtii, Clostridium acetobutylicum, Clostridium acetobutylicum, Clostridium difficile, Clostridium pasteurianum, Clostridium perfringens, Clostridium sporogenes, Ficaria verna, Hevea brasiliensis, Lactobacillus delbrueckii, Methanothermus fervidus, Pisum sativum, Ricinus communis, Spinacia oleracea, Streptococcus agalactiae, Streptococcus equinus, Streptococcus mutans, Streptococcus pyogenes, Sulfolobus solfataricus, Sulfolobus solfataricus, Sulfolobus solfataricus, Sulfolobus solfataricus, Synechococcus elongatus* PCC 7942, *Talipariti tiliaceum, Thermoproteus tenax, Triticum aestivum,* or *Zea mays.*

The GAPN may be a gram-positive bacterial GAPN, such as a *Bacillus, Streptococcus, Streptomyces, Staphylococcus, Enterococcus, Lactobacillus, Lactococcus, Clostridium, Geobacillus,* or *Oceanobacillus* GAPN. In one aspect, the GAPN is a *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis,* or *Bacillus thuringiensis* GAPN. In another aspect, the GAPN is a *Streptococcus equisimilis, Streptococcus pyogenes, Streptococcus uberis,* or *Streptococcus equi* subsp. *Zooepidemicus* GAPN. In another aspect, the GAPN is a *Streptomyces achromogenes, Streptomyces avermitilis, Streptomyces coelicolor, Streptomyces griseus,* or *Streptomyces lividans* GAPN.

In one aspect, the GAPN is a *Streptococcus* GAPN, such as the *Streptococcus mutans* GAPN of SEQ ID NO: 154, or the *Streptococcus equinus* GAPN of SEQ ID NO: 158. In one aspect, the GAPN is a *Clostridium* GAPN, such as the *Clostridium acetobutylicum* GAPN of SEQ ID NO: 190. In one aspect, the GAPN is a *Zea* GAPN, such as the *Zea mays* GAPN of SEQ ID NO: 159 or 192. In one aspect, the GAPN is a *Lactobacillus* GAPN, such as the *Lactobacillus delbrueckii* GAPN of SEQ ID NO: 194.

It will be understood that for the aforementioned species, both the perfect and imperfect states, and other taxonomic equivalents, e.g., anamorphs, are encompassed regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

The GAPN coding sequences, or subsequences thereof; as well as the corresponding amino acid sequence, or fragments thereof; may be used to design nucleic acid probes to identify and clone GAPNs from strains of different genera or species according to methods well known in the art. In particular, such probes can be used for hybridization with the genomic or cDNA of the genus or species of interest, following standard Southern blotting procedures, in order to identify and isolate the corresponding gene therein. Such probes can be considerably shorter than the entire sequence, e.g., at least 14 nucleotides, at least 25 nucleotides, at least 35 nucleotides, at least 70 nucleotides in lengths. The probes may be longer, e.g., at least 100 nucleotides, at least 200 nucleotides, at least 300 nucleotides, at least 400 nucleotides, at least 500 nucleotides in lengths. Even longer probes may be used, e.g., at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}P$, $^{3}H$, $^{35}S$, biotin, or avidin).

A genomic DNA or cDNA library prepared from such other strains may be screened for DNA that hybridizes with the probes described above and encodes a polypeptide having GAPN activity. Genomic or other DNA from such other strains may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that is homologous with the GAPN coding sequences, or a subsequence thereof, the carrier material may be used in a Southern blot.

For purposes of the probes described above, hybridization indicates that the polynucleotide hybridizes to a labeled nucleic acid probe, or the full-length complementary strand thereof, or a subsequence of the foregoing; under very low to very high stringency conditions. Molecules to which the nucleic acid probe hybridizes under these conditions can be detected using, for example, X-ray film. For long probes of at least 100 nucleotides in length, very low to very high stringency and washing conditions are defined as described supra. For short probes of about 15 nucleotides to about 70 nucleotides in length, stringency and washing conditions are defined as described supra.

GAPNs may also be identified and obtained from other sources including microorganisms isolated from nature (e.g., soil, composts, water, silage, etc.) or DNA samples obtained directly from natural materials (e.g., soil, composts, water, silage, etc.) using the above-mentioned probes. Techniques for isolating microorganisms and DNA directly from natural habitats are well known in the art. The polynucleotide encoding a GAPN may then be derived by similarly screening a genomic or cDNA library of another microorganism or mixed DNA sample. Once a polynucleotide encoding a GAPN has been detected with a suitable probe as described herein, the sequence may be isolated or cloned by utilizing techniques that are known to those of ordinary skill in the art (see, e.g., J. Sambrook, E. F. Fritsch, and T. Maniatus, 1989, *Molecular Cloning, A Laboratory Manual*, 2d edition, Cold Spring Harbor, New York).

Techniques used to isolate or clone polynucleotides encoding GAPNs include isolation from genomic DNA, preparation from cDNA, or a combination thereof. The cloning of the polynucleotides from such genomic DNA can be effected, e.g., by using the well-known polymerase chain reaction (PCR) or antibody screening of expression libraries to detect cloned DNA fragments with shares structural features. See, e.g., Innis et al., 1990, *PCR: A Guide to Methods and Application*, Academic Press, New York. Other nucleic acid amplification procedures such as ligase chain reaction (LCR), ligated activated transcription (LAT) and nucleotide sequence-based amplification (NASBA) may be used.

In one aspect, the GAPN has at least 50%, e.g., at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% sequence identity to any GAPN described herein (e.g., any GAPN of SEQ ID NO: 154, 155, 156, 157, 158, 159, 160, 161, 162, 189, 190, 192, or 194). In one aspect, the GAPN sequence differs by no more than ten amino acids, e.g., by no more than five amino acids, by no more than four amino acids, by no more than three amino acids, by no more than two amino acids, or by one amino acid from any GAPN described herein (e.g., any GAPN of SEQ ID NO: 154, 155, 156, 157, 158, 159, 160, 161, 162, 189, 190, 192, or 194). In one aspect, the GAPN comprises or consists of the amino acid sequence of any GAPN described herein (e.g., any GAPN of SEQ ID NO: 154, 155, 156, 157, 158, 159, 160, 161, 162, 189, 190, 192, or 194), allelic variant, or a fragment thereof having GAPN activity. In one aspect, the GAPN has an amino acid substitution, deletion, and/or insertion of one or more (e.g., two, several) amino acids. In some aspects, the total number of amino acid substitutions, deletions and/or insertions is not more than 10, e.g., not more than 9, 8, 7, 6, 5, 4, 3, 2, or 1.

The amino acid changes are generally of a minor nature, that is conservative amino acid substitutions or insertions that do not significantly affect the folding and/or activity of the protein; small deletions, typically of one to about 30 amino acids; small amino-terminal or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

Examples of conservative substitutions are within the group of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the GAPN, alter the substrate specificity, change the pH optimum, and the like.

Essential amino acids can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for GAPN activity to identify amino acid residues that are critical to the activity of the molecule. See also, Hilton et al., 1996, *J. Biol. Chem.* 271: 4699-4708. The active site of the GAPN or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identities of essential amino acids can also be inferred from analysis of identities with other GAPNs that are related to the referenced GAPN.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241: 53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active GAPNs can be recovered from the host cells and rapidly sequenced using standard methods in the art. These methods allow the rapid determination of the importance of individual amino acid residues in a polypeptide.

In some aspects, the GAPN has at least 20%, e.g., at least 40%, at least 50%, at least 60%, at least 70%, at least 80%, at least 90%, at least 95%, at least 96%, at least 97%, at least 98%, at least 99%, or 100% of the GAPN activity of any GAPN described herein (e.g., any GAPN of SEQ ID NO: 154, 155, 156, 157, 158, 159, 160, 161, 162, 189, 190, 192, or 194) under the same conditions.

In one aspect, the GAPN coding sequence hybridizes under at least low stringency conditions, e.g., medium stringency conditions, medium-high stringency conditions, high stringency conditions, or very high stringency conditions with the full-length complementary strand of the coding sequence from any GAPN described herein (e.g., any GAPN of SEQ ID NO: 154, 155, 156, 157, 158, 159, 160, 161, 162, 189, 190, 192, or 194) (see, e.g., J. Sambrook, E. F. Fritsch, and T. Maniatus, 1989, supra). In one aspect, the GAPN coding sequence has at least 65%, e.g., at least 70%, at least 75%, at least 80%, at least 85%, at least 85%, at least 90%, at least 91%, at least 92%, at least 93%, at least 94%, at least 95%, at least 96%, at least 97%, at least 98%, at least 99%, or 100% sequence identity with the coding sequence from any GAPN described herein (e.g., any GAPN of SEQ ID NO: 154, 155, 156, 157, 158, 159, 160, 161, 162, 189, 190, 192, or 194).

In one aspect, the heterologous polynucleotide encoding the GAPN comprises the coding sequence of any GAPN described herein (e.g., any GAPN of SEQ ID NO: 154, 155, 156, 157, 158, 159, 160, 161, 162, 189, 190, 192, or 194). In one aspect, the heterologous polynucleotide encoding the GAPN comprises a subsequence of the coding sequence from any GAPN described herein, wherein the subsequence encodes a polypeptide having GAPN activity. In one aspect, the number of nucleotides residues in the coding subsequence is at least 75%, e.g., at least 80%, 85%, 90%, or 95% of the number of the referenced coding sequence.

The referenced coding sequence of any related aspect described herein can be the native coding sequence (e.g., a sequence readily determined by the skilled artisan using available sequence databases) or a degenerate sequence, such as a codon-optimized coding sequence designed for a particular host cell. For example, the coding sequence for the *Streptococcus mutans* GAPN of SEQ ID NO: 154 can be the native *Streptococcus mutans* GAPN coding sequence or a codon-optimized version, such as the coding sequence shown in SEQ ID NO: 154.

The GAPN may be a fused polypeptide or cleavable fusion polypeptide in which another polypeptide is fused at the N-terminus or the C-terminus of the GAPN. A fused polypeptide may be produced by fusing a polynucleotide encoding another polypeptide to a polynucleotide encoding the GAPN. Techniques for producing fusion polypeptides are known in the art, and include ligating the coding sequences encoding the polypeptides so that they are in frame and that expression of the fused polypeptide is under control of the same promoter(s) and terminator. Fusion proteins may also be constructed using intein technology in which fusions are created post-translationally (Cooper et al., 1993, *EMBO J.* 12: 2575-2583; Dawson et al., 1994, *Science* 266: 776-779).

Active 3-HP Pathway

Any suitable 3-HP pathway can be used with the recombinant yeast cell having a heterologous GAPN to produce 3-HP. 3-HP pathways, 3-HP pathway genes and corresponding engineered transformants for fermentation of 3-HP are known in the art (e.g., US Publication No. 2012/0135481; U.S. Pat. No. 6,852,517; U.S. Pat. No. 7,309,597; US Pub. No. 2001/0021978; US Pub. No. 2008/0199926; WO02/42418; and WO10/031083; the content of which is hereby incorporated in its entirety). An overview of several known 3-HP pathways is shown in FIG. 1.

In certain embodiments, the yeast cells provided herein have an active 3-HP pathway that proceeds through PEP or pyruvate, OAA, aspartate, β-alanine, and malonate semialdehyde intermediates (see, e.g., US Pub. No. 2010/0021978, FIG. 1). In these embodiments, the yeast cells comprise a set of 3-HP pathway genes comprising one or more of pyruvate carboxylase (PYC), PEP carboxylase (PPC), aspartate aminotransferase (AAT), aspartate 1-decarboxylase (ADC), β-alanine aminotransferase (BAAT), aminobutyrate aminotransferase (gabT), 3-HP dehydrogenase (3-HPDH), 3-hydroxyisobutyrate dehydrogenase (HIBADH), and 4-hydroxybutyrate dehydrogenase genes. The 3-HP pathway genes may also include a PEP carboxykinase (PCK) gene that has been modified to produce a polypeptide that preferably catalyzes the conversion of PEP to OAA (native PCK genes generally produce a polypeptide that preferably catalyzes the reverse reaction of OAA to PEP).

In certain embodiments, the yeast cells provided herein have an active 3-HP pathway that proceeds through PEP or pyruvate, OAA, and malate intermediates (see, e.g., US Pub. No. 2010/0021978, FIG. 4). In these embodiments, the yeast cells comprise a set of 3-HP pathway genes comprising one or more of PPC, PYC, malate dehydrogenase, and malate decarboxylase genes. The 3-HP pathway genes may also include a PCK gene that has been modified to produce a polypeptide that preferably catalyzes the conversion of PEP to OAA.

In certain embodiments, the yeast cells provided herein have an active 3-HP pathway that proceeds through PEP or pyruvate, OAA, and malonate semialdehyde intermediates (see, e.g., US Pub. No. 2010/0021978, FIG. 1). In these embodiments, the yeast cells comprise a set of 3-HP pathway genes comprising one or more of PPC, PYC, 2-keto acid decarboxylase, alpha-ketoglutarate (AKG) decarboxylase (KGD), branched-chain alpha-keto acid decarboxylase (BCKA), indolepyruvate decarboxylase (IPDA), 3-HPDH, HIBADH, and 4-hydroxybutyrate dehydrogenase genes. The 3-HP pathway genes may also include a PCK gene that has been modified to produce a polypeptide that preferably catalyzes the conversion of PEP to OAA. Further, the 3-HP pathway genes may include a PDC gene and/or benzoylformate decarboxylase gene that has been modified to encode a polypeptide capable of catalyzing the conversion of OAA to malonate semialdehyde.

In certain embodiments, the yeast cells provided herein have an active 3-HP pathway that proceeds through PEP or pyruvate, OAA, malonyl-CoA, and malonate semialdehyde intermediates, wherein the malonate semialdehyde intermediate is optional (see, e.g., US Pub. No. 2010/0021978, FIG. 2). In these embodiments, the yeast cells comprise a set of 3-HP pathway genes comprising one or more of PPC, PYC, OAA formatelyase, malonyl-CoA reductase, CoA acylating malonate semialdehyde dehydrogenase, 3-HPDH, HIBADH, and 4-hydroxybutyrate dehydrogenase genes. The 3-HP pathway genes may also include a PCK gene that has been modified to produce a polypeptide that preferably catalyzes the conversion of PEP to OAA. Further, the 3-HP pathway genes may include an OAA dehydrogenase gene derived by modifying a 2-keto-acid dehydrogenase gene to produce a polypeptide that catalyzes the conversion of OAA to malonyl-CoA.

In certain embodiments, the yeast cells provided herein have an active 3-HP pathway that proceeds through pyruvate, acetyl-CoA, malonyl-CoA, and malonate semialdehyde intermediates, wherein the malonate semialdehyde intermediate is optional (see, e.g., WO02/042418, FIG. 44). In these embodiments, the yeast cells comprise a set of 3-HP pathway genes comprising one or more of pyruvate dehydrogenase (PDH), acetyl-CoA carboxylase (ACC), malonyl-CoA reductase, CoA acylating malonate semialdehyde dehydrogenase, 3-HPDH, HIBADH, and 4-hydroxybutyrate dehydrogenase genes.

In certain embodiments, the yeast cells provided herein have an active 3-HP pathway that proceeds through pyruvate, alanine, β-alanine, β-alanyl-CoA, acrylyl-CoA, 3-HP-CoA, and malonate semialdehyde intermediates, wherein the β-alanyl-CoA, acrylyl-CoA, 3-HP-CoA, and malonate semialdehyde intermediates are optional (β-alanine can be converted to 3-HP via a malonate semialdehyde intermediate or via β-alanyl-CoA, acrylyl-CoA, and 3-HP-CoA intermediates (see, e.g., U.S. Pat. No. 7,309,597, FIG. 1). In these embodiments, the yeast cells comprise a set of 3-HP pathway genes comprising one or more of alanine dehydrogenase, pyruvate/alanine aminotransferase, alanine 2,3 aminomutase, CoA transferase, CoA synthetase, β-alanyl-CoA ammonia lyase, 3-HP-CoA dehydratase, 3-HP-CoA hydrolase, 3-hydroxyisobutyryl-CoA hydrolase, BAAT, 3-HPDH, HIBADH, and 4-hydroxybutyrate dehydrogenase genes.

In certain embodiments, the yeast cells provided herein have an active 3-HP pathway that proceeds through pyruvate, lactate, lactyl-CoA, acrylyl-CoA, and 3-HP-CoA intermediates (see, e.g., WO02/042418, FIG. 1). In these embodiments, the yeast cells comprise a set of 3-HP pathway genes comprising one or more of LDH, CoA transferase, CoA synthetase, lactyl-CoA dehydratase, 3-HP-CoA dehydratase, 3-HP-CoA hydrolase, and 3-hydroxyisobutyryl-CoA hydrolase genes.

In certain embodiments, the yeast cells provided herein have an active 3-HP pathway that proceeds through glycerol and 3-HPA intermediates (see, e.g., U.S. Pat. No. 6,852,517). In these embodiments, the yeast cells comprise a set of 3-HP pathway genes comprising one or more of glycerol dehydratase and aldehyde dehydrogenase genes.

In certain embodiments, the yeast cells provided herein have an active 3-HP pathway that proceeds through PEP or pyruvate, OAA, aspartate, β-alanine, β-alanyl-CoA, acrylyl-CoA, 3-HP-CoA, and alanine intermediates, wherein the OAA, aspartate, and alanine intermediates are optional (PEP or pyruvate can be converted to β-alanine via OAA and aspartate or via alanine) (see WO02/042418, FIG. 54; U.S. Pat. No. 7,309,597, FIG. 1). In these embodiments, the yeast cells comprise a set of 3-HP pathway genes comprising one or more of PPC, PYC, AAT, ADC, CoA transferase, CoA synthetase, β-alanyl-CoA ammonia lyase, 3-HP-CoA dehydratase, 3-HP-CoA hydrolase, 3-hydroxyisobutyryl-CoA hydrolase, alanine dehydrogenase, pyruvate/alanine aminotransferase, and AAM genes. The 3-HP pathway genes may also include a PCK gene that has been modified to produce a polypeptide that preferably catalyzes the conversion of PEP to OAA.

In certain embodiments, the yeast cells provided herein express one or more 3-HP pathway genes encoding enzymes selected from the group consisting of ACC (catalyzes the conversion of acetyl-CoA to malonyl-CoA), alanine 2,3 aminomutase (AAM, catalyzes the conversion of alanine to β-alanine), alanine dehydrogenase (catalyzes the conversion of pyruvate to alanine), aldehyde dehydrogenase (catalyzes the conversion of 3-HPA to 3-HP), KGD (catalyzes the conversion of OAA to malonate semialdehyde), AAT (catalyzes the conversion of OAA to aspartate), ADC (catalyzes the conversion of aspartate to β-alanine), BCKA (catalyzes the conversion of OAA to malonate semialdehyde), BAAT (catalyzes the conversion of β-alanine to malonate semialdehyde), 4-aminobutyrate aminotransferase (gabT, catalyzes the conversion of β-alanine to malonate semialdehyde), β-alanyl-CoA ammonia lyase (catalyzes the conversion of β-alanyl-CoA to acrylyl-CoA), Co-A acylating malonate semialdehyde dehydrogenase (catalyzes the conversion of malonyl-CoA to malonate semialdehyde), CoA synthetase (catalyzes the conversion of β-alanine to β-alanyl-CoA or the conversion of lactate to lactyl-CoA), CoA transferase (catalyzes the conversion of β-alanine to β-alanyl-CoA and/or the conversion of lactate to lactyl-CoA), glycerol dehydratase (catalyzes the conversion of glycerol to 3-HPA), IPDA (catalyzes the conversion of OAA to malonate semialdehyde), LDH (catalyzes the conversion of pyruvate to lactate), lactyl-CoA dehydratase (catalyzes the conversion of lactyl-CoA to acrylyl-CoA), malate decarboxylase (catalyzes the conversion of malate to 3-HP), malate dehydrogenase (catalyzes the conversion of OAA to malate), malonyl-CoA reductase (catalyzes the conversion of malonyl-CoA to malonate semialdehyde or 3-HP), OAA formatelyase (also known as pyruvate-formate lyase and ketoacid formate-lyase, catalyzes the conversion of OAA to malonyl-CoA), OAA dehydrogenase (catalyzes the conversion of OAA to malonyl CoA); PPC (catalyzes the conversion of PEP to OAA), pyruvate/alanine aminotransferase (catalyzes the conversion of pyruvate to alanine), PYC (catalyzes the conversion of pyruvate to OAA), PDH (catalyzes the conversion of pyruvate to acetyl-CoA), 2-keto acid decarboxylase (catalyzes the conversion of OAA to malonate semialdehyde), 3-HP-CoA dehydratase (also known as acrylyl-CoA hydratase, catalyzes the conversion of acrylyl-CoA to 3-HP-CoA), 3-HPDH (catalyzes the conversion of malonate semialdehyde to 3-HP), 3-HP-CoA hydrolase (catalyzes the conversion of 3-HP-CoA to 3-HP), HIBADH (catalyzes the conversion of malonate semialdehyde to 3-HP), 3-hydroxyisobutyryl-CoA hydrolase (catalyzes the conversion of 3-HP-CoA to 3-HP), and 4-hydroxybutyrate dehydrogenase (catalyzes the conversion of malonate semialdehyde to 3-HP). For each of these enzyme activities, the reaction of interest in parentheses may be a result of endogenous or heterologous activity.

Any suitable 3-HP pathway gene, endogenous or heterologous, may be used and expressed in sufficient amount to produce an enzyme involved in a selected active 3-HP pathway. With the complete genome sequence available for now more than 550 species (with more than half of these available on public databases such as the NCBI), including 395 microorganism genomes and a variety of yeast, fungi, plant, and mammalian genomes, the identification of genes encoding the selected 3-HP pathway enzymatic activities taught herein is routine and well known in the art for a selected host. For example, suitable homologues, orthologs, paralogs and non-orthologous gene displacements of known genes, and the interchange of genetic alterations between organisms can be identified in related or distant host to a selected host.

For yeasts without a known genome sequence, sequences for genes of interest (either as overexpression candidates or as insertion sites) can typically be obtained using techniques known in the art. Routine experimental design can be employed to test expression of various genes and activity of various enzymes, including genes and enzymes that function in a 3-HP pathway. Experiments may be conducted wherein each enzyme is expressed in the yeast individually and in blocks of enzymes up to and including preferably all pathway enzymes, to establish which are needed (or desired) for improved 3-HP production. One illustrative experimental design tests expression of each individual enzyme as well as of each unique pair of enzymes, and further can test expression of all required enzymes, or each unique combination of enzymes. A number of approaches can be taken, as will be appreciated.

The recombinant host cells of the invention can be produced by introducing heterologous polynucleotides encoding one or more of the enzymes participating in a 3-HP pathway, as described below. As one in the art will appreciate, in some instances (e.g., depending on the selection of host) the heterologous expression of every gene shown in the 3-HP pathway may not be required for 3-HP production given that a host cell may have endogenous enzymatic activity from one or more pathway genes. For example, if a chosen host is deficient in one or more enzymes of a 3-HP pathway, then heterologous polynucleotides for the deficient enzyme(s) are introduced into the host for subsequent expression. Alternatively, if the chosen host exhibits endogenous expression of some pathway genes, but is deficient in others, then an encoding polynucleotide is needed for the deficient enzyme(s) to achieve 3-HP biosynthesis. Thus, a recombinant host cell of the invention can be produced by introducing heterologous polynucleotides to obtain the enzyme activities of a desired biosynthetic pathway or a desired biosynthetic pathway can be obtained by introducing one or more heterologous polynucleotides that, together with one or more endogenous enzymes, produces a desired product such as 3-HP.

Depending on the 3-HP pathway constituents of a selected recombinant host organism, the host cells of the invention will include at least one heterologous polynucleotide encoding a GAPN, at least one heterologous polynucleotide encoding an enzyme of a 3-HP pathway gene and up to all encoding heterologous polynucleotides for the 3-HP pathway. For example, 3-HP biosynthesis can be established in a host deficient in a 3-HP pathway enzyme through heterologous expression of the corresponding polynucleotide. In a host deficient in all enzymes of a 3-HP pathway, heterologous expression of all enzymes in the pathway can be included, although it is understood that all enzymes of a pathway can be expressed even if the host contains at least one of the pathway enzymes.

A "pyruvate carboxylase gene" or "PYC gene" as used herein refers to any gene that encodes a polypeptide with pyruvate carboxylase activity, meaning the ability to catalyze the conversion of pyruvate, $CO_2$, and ATP to OAA, ADP, and phosphate. In certain embodiments, a PYC gene may be derived from a yeast source. For example, the PYC gene may be derived from an *I. orientalis* PYC gene encoding the amino acid sequence set forth in SEQ ID NO: 2. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 2. In certain embodiments, an *I. orientalis*-derived PYC gene may comprise the nucleotide sequence set forth in SEQ ID NO: 1 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 1. In other embodiments, the PYC gene may be derived from a bacterial source. For example, the PYC gene may be derived from one of the few bacterial species that use only PYC and not PPC (see below) for anaplerosis, such as *R. sphaeroides*, or from a bacterial species that possesses both PYC and PPC, such as *R. etli*. The amino acid sequences encoded by the PYC genes of *R. sphaeroides* and *R. etli* are set forth in SEQ ID NOs: 3 and 4, respectively. A PYC gene may be derived from a gene encoding the amino acid sequence of SEQ ID NOs: 3 or 4, or from a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NOs: 3 or 4. Alternatively, the PYC gene may be derived from a PYC gene encoding an enzyme that does not have a dependence on acetyl-CoA for activation, such as a *P. fluorescens* PYC gene encoding the amino acid sequence set forth in SEQ ID NO: 5 (carboxytransferase subunit) or SEQ ID NO: 6 (biotin carboxylase subunit), a *C. glutamicum* PYC gene of encoding the amino acid sequence set forth in SEQ ID NO: 7, or a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NOs: 5, 6, or 7. A PYC gene may also be derived from a PYC gene that encodes an enzyme that is not inhibited by aspartate, such as an *S. meliloti* PYC gene encoding the amino acid sequence set forth in SEQ ID NO: 8 (Sauer FEMS Microbiol Rev 29:765 (2005), or from a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NO: 8.

A "PEP carboxylase gene" or "PPC gene" as used herein refers to any gene that encodes a polypeptide with PEP carboxylase activity, meaning the ability to catalyze the conversion of PEP and $CO_2$ to OAA and phosphate. In certain embodiments, a PPC gene may be derived from a bacterial PPC gene. For example, the PPC gene may be derived from an *E. coli* PPC gene encoding the amino acid sequence set forth in SEQ ID NO: 10 or an amino acid sequence with at least 50%, at least 60%, at least 70%, at least 80%, at least 85%, at least 90%, at least 95%, at least 97%, or at least 99% sequence identity to the amino acid sequence of SEQ ID NO: 10. In certain embodiments, an *E. coli*-derived PPC gene may comprise the nucleotide sequence set forth in SEQ ID NO: 9 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 9. In other embodiments, a PPC gene may be derived from an "A" type PPC, found in many archea and a limited number of bacteria, that is not activated by acetyl CoA and is less inhibited by aspartate. For example, a PPC gene may be derived from an *M. thermoautotrophicum* PPC A gene encoding the amino acid sequence set forth in SEQ ID NO: 11, a *C. perfringens* PPC A gene encoding the amino acid sequence set forth in SEQ ID NO: 12, or a gene encoding an amino acid sequence with at least 50%, at least 60%, at least 70%, at least 80%, at least 85%, at least 90%, at least 95%, at least 97%, or at least 99% sequence identity to the amino acid sequence of SEQ ID NOs: 11 or 12. In certain of these embodiments, the gene may have undergone one or more mutations versus the native gene in order to generate an enzyme with improved characteristics. For example, the gene may have been mutated to encode a PPC polypeptide with increased resistance to aspartate feedback versus the native polypeptide. In other embodiments, the PPC gene may be derived from a plant source.

An "aspartate aminotransferase gene" or "AAT gene" as used herein refers to any gene that encodes a polypeptide with aspartate aminotransferase activity, meaning the ability to catalyze the conversion of OAA to aspartate. Enzymes having aspartate aminotransferase activity are classified as EC 2.6.1.1. In certain embodiments, an AAT gene may be derived from a yeast source such as *I. orientalis* or *S. cerevisiae*. For example, the AAT gene may be derived from an *I. orientalis* AAT gene encoding the amino acid sequence set forth in SEQ ID NO: 14 or an *S. cerevisiae* AAT2 gene encoding the amino acid sequence set forth in SEQ ID NO: 15. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NOs: 14 or 15. In certain embodiments, an *I. orientalis*-derived AAT gene may comprise the nucleotide sequence set forth in SEQ ID NO: 13 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 13. In other embodiments, the AAT gene may be derived from a bacterial source. For example, the AAT gene may be derived from an *E. coli* aspC gene encoding a polypeptide comprising the amino acid sequence set forth in SEQ ID NO: 16. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 16.

An "aspartate decarboxylase gene" or "ADC gene" as used herein refers to any gene that encodes a polypeptide with aspartate decarboxylase activity, meaning the ability to catalyze the conversion of aspartate to β-alanine. Enzymes having aspartate decarboxylase activity are classified as EC 4.1.1.11. In certain embodiments, an ADC gene may be derived from a bacterial source. Because an active aspartate decarboxylase may require proteolytic processing of an inactive proenzyme, in these embodiments the yeast host cell should be selected to support formation of an active enzyme coded by a bacterial ADC gene.

In some embodiments, the ADC gene may be derived from an *S. avermitilis* panD gene encoding the amino acid sequence set forth in SEQ ID NO: 17. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 17. In certain embodiments, an *S. avermitilis*-derived ADC gene may comprise the nucleotide sequence set forth in any one of SEQ ID NOs: 130, 145, 146, or 147; or a nucleotide sequence with at least 50%, at least 60%, at least 70%, at least 80%, at least 85%, at least 90%, at least 95%, at least 97%, or at least 99% sequence identity to the nucleotide sequence set forth in any one of SEQ ID NOs: 130, 145, 146, or 147.

In other embodiments, the ADC gene may be derived from a *C. acetobutylicum* panD gene encoding the amino acid sequence set forth in SEQ ID NO: 18. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 18. In certain embodiments, a *C. acetobutylicum*-derived ADC gene may comprise the nucleotide sequence set forth in SEQ ID NO: 131, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 131.

In other embodiments, the ADC gene may be derived from a *H. pylori* ADC gene encoding the amino acid sequence set forth in SEQ ID NO: 133. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 133. In certain embodiments, a *H. pylori*-derived ADC gene may comprise the nucleotide sequence set forth in SEQ ID NO: 133, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 133.

In other embodiments, the ADC gene may be derived from a *Bacillus* sp. TS25 ADC gene encoding the amino acid sequence set forth in SEQ ID NO: 135. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 135. In certain embodiments, a *Bacillus* sp. TS25-derived ADC gene may comprise the nucleotide sequence set forth in SEQ ID NO: 134, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 134.

In other embodiments, the ADC gene may be derived from a *C. glutamicum* ADC gene encoding the amino acid sequence set forth in SEQ ID NO: 137. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 137. In certain embodiments, a *C. glutamicum*-derived ADC gene may comprise the nucleotide sequence set forth in SEQ ID NO: 136, or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 136.

In other embodiments, the ADC gene may be derived from a *B. licheniformis* ADC gene encoding the amino acid sequence set forth in SEQ ID NO: 139. In some embodiments, the ADC gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 139. In certain embodiments, a *B. licheniformis*-derived ADC gene may comprise the nucleotide sequence set forth in any one of SEQ ID NOs: 138, 148, 149, 150, or 151; or a nucleotide sequence with at least 50%, at least 60%, at least 70%, at least 80%, at least 85%, at least 90%, at least 95%, at least 97%, or at least 99% sequence identity to the nucleotide sequence set forth in any one of SEQ ID NOs: 138, 148, 149, 150, or 151.

A "β-alanine aminotransferase gene" or "BAAT gene" as used herein refers to any gene that encodes a polypeptide with β-alanine aminotransferase activity, meaning the ability to catalyze the conversion of β-alanine to malonate semialdehyde. Enzymes having β-alanine aminotransferase activity are classified as EC 2.6.1.19. In certain embodiments, a BAAT gene may be derived from a yeast source. For example, a BAAT gene may be derived from the *I. orientalis* homolog to the pyd4 gene encoding the amino acid sequence set forth in SEQ ID NO: 20. In some embodiments, the BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 20. In certain embodiments, an *I. orientalis*-derived BAAT gene may comprise the nucleotide sequence set forth in SEQ ID NO: 19 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 19. In other embodiments, the BAAT gene may be derived from the *S. kluyveri* pyd4 gene encoding the amino acid sequence set forth in SEQ ID NO: 21. In some embodiments, the BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 21. In certain embodiments, a *S. kluyveri*-derived BAAT gene may comprise the nucleotide sequence set forth in SEQ ID NO: 142 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 142. In other embodiments, the BAAT gene may be derived from a bacterial source. For example, a BAAT gene may be derived from an *S. avermitilis* BAAT gene encoding the amino acid sequence set forth in SEQ ID NO: 22. In some embodiments, the BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 22. In certain embodiments, a *S. avermitilis*-derived BAAT gene may comprise the nucleotide sequence set forth in SEQ ID NO: 140 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 140.

A BAAT gene may also be a "4-aminobutyrate aminotransferase" or "gabT gene" meaning that it has native activity on 4-aminobutyrate as well as β-alanine. Alternatively, a BAAT gene may be derived by random or directed engineering of a native gabT gene from a bacterial or yeast source to encode a polypeptide with BAAT activity. For example, a BAAT gene may be derived from the *S. avermitilis* gabT encoding the amino acid sequence set forth in SEQ ID NO: 23. In some embodiments, the *S. avermitilis*-derived BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 23. In other embodiments, a BAAT gene may be derived from the *S. cerevisiae* gabT gene UGA1 encoding the amino acid sequence set forth in SEQ ID NO: 24. In some embodiments, the *S. cerevisiae*-derived BAAT gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 24. In certain embodiments, an *S. cerevisiae*-derived BAAT gene may comprise the nucleotide sequence set forth in SEQ ID NO: 141 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 141.

A "3-HP dehydrogenase gene" or "3-HPDH gene" as used herein refers to any gene that encodes a polypeptide with 3-HP dehydrogenase activity, meaning the ability to catalyze the conversion of malonate semialdehyde to 3-HP. Enzymes having 3-HP dehydrogenase activity are classified as EC 1.1.1.59 if they utilize an NAD(H) cofactor, and as EC 1.1.1.298 if they utilize an NADP(H) cofactor. Enzymes classified as EC 1.1.1.298 are alternatively referred to as malonate semialdehyde reductases.

In certain embodiments, a 3-HPDH gene may be derived from a yeast source. For example, a 3-HPDH gene may be derived from the *I. orientalis* homolog to the YMR226C gene encoding the amino acid sequence set forth in SEQ ID NO: 26. In some embodiments, the 3-HPDH gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 26. In certain embodiments, an *I. orientalis*-derived 3-HPDH gene may comprise the nucleotide sequence set forth in SEQ ID NO: 25 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 25. In other embodiments, a 3-HPDH gene may be derived from the *S. cerevisiae* YMR226C gene encoding the amino acid sequence set forth in SEQ ID NO: 129. In some embodiments, the 3-HPDH gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 129. In certain embodiments, an *S. cerevisiae*-derived 3-HPDH gene may comprise the nucleotide sequence set forth in SEQ ID NO: 144 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 144.

In other embodiments, the 3-HPDH gene may be derived from a bacterial source. For example, a 3-HPDH gene may be derived from an *E. coli* ydfG gene encoding the amino acid sequence in SEQ ID NO: 27. In some embodiments, the gene may encode an amino acid sequence with at least 50%, at least 60%, at least 70%, at least 80%, at least 85%, at least 90%, at least 95%, at least 97%, or at least 99% sequence identity to the amino acid sequence of SEQ ID NO: 27. In certain embodiments, an *E. coli*-derived 3-HPDH gene may comprise the nucleotide sequence set forth in SEQ ID NO: 143 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 143. In other embodiments, a 3-HPDH gene may be derived from an *M. sedula* malonate semialdehyde reductase gene encoding the amino acid sequence set forth in SEQ ID NO: 29. In some embodiments, the 3-HPDH gene may encode an amino acid sequence with at least 50%, at least 60%, at least 70%, at least 80%, at least 85%, at least 90%, at least 95%, at least 97%, or at least 99% sequence identity to the amino acid sequence set forth in SEQ ID NO: 29. In certain embodiments, an *M. sedula*-derived 3-HPDH gene may comprise the nucleotide sequence set forth in SEQ ID NO: 152 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 152.

A "3-hydroxyisobutyrate dehydrogenase gene" or "HIBADH gene" as used herein refers to any gene that encodes a polypeptide with 3-hydroxyisobutyrate dehydrogenase activity, meaning the ability to catalyze the conversion of 3-hydroxyisobutyrate to methylmalonate semialdehyde. Enzymes having 3-hydroxyisobutyrate dehydrogenase activity are classified as EC 1.1.1.31. Some 3-hydroxyisobutyrate dehydrogenases also have 3-HPDH activity. In certain embodiments, an HIBADH gene may be derived from a bacterial source. For example, an HIBADH gene may be derived from an *A. faecalis* M3A gene encoding the amino acid sequence set forth in SEQ ID NO: 28, a *P. putida* KT2440 or E23440 mmsB gene encoding the amino acid sequence set forth in SEQ ID NO: 30 or SEQ ID NO: 31, respectively, or a

*P. aeruginosa* PAO1 mmsB gene encoding the amino acid sequence set forth in SEQ ID NO: 32. In certain embodiments, an HIBADH gene may encode an amino acid sequence with at least 50%, at least 60%, at least 70%, at least 80%, at least 85%, at least 90%, at least 95%, at least 97%, or at least 99% sequence identity to the amino acid sequence set forth in SEQ ID NOs: 28, 30, 31, or 32.

A "4-hydroxybutyrate dehydrogenase gene" as used herein refers to any gene that encodes a polypeptide with 4-hydroxybutyrate dehydrogenase activity, meaning the ability to catalyze the conversion of 4-hydroxybutanoate to succinate semialdehyde. Enzymes having 4-hydroxybutyrate dehydrogenase activity are classified as EC 1.1.1.61. Some 4-hydroxybutyrate dehydrogenases also have 3-HPDH activity. In certain embodiments, a 4-hydroxybutyrate dehydrogenase gene may be derived from a bacterial source. For example, a 4-hydroxybutyrate dehydrogenase gene may be derived from a *R. eutropha* H16 4hbd gene encoding the amino acid sequence set forth in SEQ ID NO: 33 or a *C. kluyveri* DSM 555 hbd gene encoding the amino acid sequence set forth in SEQ ID NO: 34. In other embodiments, the gene may encode an amino acid sequence with at least 50%, at least 60%, at least 70%, at least 80%, at least 85%, at least 90%, at least 95%, at least 97%, or at least 99% sequence identity to the amino acid sequence set forth in SEQ ID NOs: 33 or 34.

A "PEP carboxykinase gene" or "PCK gene" as used herein refers to any gene that encodes a polypeptide with PEP carboxykinase activity, meaning the ability to catalyze the conversion of PEP, $CO_2$, and ADP or GDP to OAA and ATP or GTP, or vice versa. Enzymes having PEP carboxykinase activity are classified as EC 4.1.1.32 (GTP/GDP utilizing) and EC 4.1.1.49 (ATP/ADP utilizing). In certain embodiments, a PCK gene may be derived from a yeast source. In other embodiments, a PCK gene may be derived from a bacterial source, and in certain of these embodiments the gene may be derived from a bacteria in which the PCK reaction favors the production of OAA rather than the more common form of the reaction where decarboxylation is dominant. For example, a PCK gene may be derived from an *M. succiniciproducens* PCK gene encoding the amino acid sequence set forth in SEQ ID NO: 35, an *A. succiniciproducens* PCK gene encoding the amino acid sequence set forth in SEQ ID NO: 36, an *A. succinogenes* PCK gene encoding the amino acid sequence set forth in SEQ ID NO: 37, or an *R. eutropha* PCK gene encoding the amino acid sequence set forth in SEQ ID NO: 38. In other embodiments, a PCK gene has undergone one or more mutations versus the native gene from which it was derived, such that the resultant gene encodes a polypeptide that preferably catalyzes the conversion of PEP to OAA. For example, a PCK gene may be derived from an *E. coli* K12 strain PCK gene encoding the amino acid sequence set forth in SEQ ID NO: 39, where the gene has been mutated to preferably catalyze the conversion of PEP to OAA. In other embodiments the conversion of PEP to OAA is catalyzed by a PEP carboxytransphosphorylase such as is found in propionic acid bacteria (e.g., *P. shermanii, A. woodii*) which use inorganic phosphate and diphosphate rather than ATP/ADP or GTP/GDP.

A "malate dehydrogenase gene" as used herein refers to any gene that encodes a polypeptide with malate dehydrogenase activity, meaning the ability to catalyze the conversion of OAA to malate. In certain embodiments, a malate dehydrogenase gene may be derived from a bacterial or yeast source.

A "malate decarboxylase gene" as used herein refers to any gene that encodes a polypeptide with malate decarboxylase activity, meaning the ability to catalyze the conversion of malate to 3-HP. Malate decarboxylase activity is not known to occur naturally. Therefore, a malate decarboxylase gene may be derived by incorporating one or more mutations into a native source gene that encodes a polypeptide with acetolactate decarboxylase activity. Polypeptides with acetolactate decarboxylase activity catalyze the conversion of 2-hydroxy-2-methyl-3-oxobutanoate to 2-acetoin, and are classified as EC 4.1.1.5. In certain embodiments, a malate decarboxylase gene may be derived from a bacterial source. For example, a malate decarboxylase gene may be derived from an *L. lactis* aldB gene encoding the amino acid sequence set forth in SEQ ID NO: 40, an *S. thermophilus* aldB gene encoding the amino acid sequence set forth in SEQ ID NO: 41, a *B. brevis* aldB gene encoding the amino acid sequence set forth in SEQ ID NO: 42, or a *E. aerogenes* budA gene encoding the amino acid sequence set forth in SEQ ID NO: 43.

An "alpha-ketoglutarate (AKG) decarboxylase gene" or "KGD gene" as used herein refers to any gene that encodes a polypeptide with alpha-ketoglutarate decarboxylase activity, meaning the ability to catalyze the conversion of alpha-ketoglutarate (2-oxoglutarate) to succinate semialdehyde. Enzymes having AKG decarboxylase activity are classified as EC 4.1.1.71. A KGD gene may be used to derive a gene encoding a polypeptide capable of catalyzing the conversion of OAA to malonate semialdehyde. This activity may be found in a native KGD gene, or it may derived by incorporating one or more mutations into a native KGD gene. In certain embodiments, a KGD gene may be derived from a bacterial source. For example, a KGD gene may be derived from a *M. tuberculosis* KGD gene encoding the amino acid sequence set forth in SEQ ID NO: 44, a *B. japonicum* KGD gene encoding the amino acid sequence set forth in SEQ ID NO: 45, or a *M. loti* (aka *Rhizobium loti*) KGD gene encoding the amino acid sequence set forth in SEQ ID NO: 46.

A "branched-chain alpha-keto acid decarboxylase gene" or "BCKA gene" as used herein refers to any gene that encodes a polypeptide with branched-chain alpha-keto acid decarboxylase activity, which can serve to decarboxylate a range of alpha-keto acids from three to six carbons in length. Enzymes having BCKA activity are classified as EC 4.1.1.72. A BCKA gene may be used to derive a gene encoding a polypeptide capable of catalyzing the conversion of OAA to malonate semialdehyde. This activity may be found in a native BCKA gene, or it may be derived by incorporating one or more mutations into a native BCKA gene. In certain embodiments, a BCKA gene may be derived from a bacterial source. For example, a BCKA gene may be derived from a *L. lactis* kdcA gene encoding the amino acid sequence set forth in SEQ ID NO: 47.

An "indolepyruvate decarboxylase gene" or "IPDA gene" as used herein refers to any gene that encodes a polypeptide with indolepyruvate decarboxylase activity, meaning the ability to catalyze the conversion of indolepyruvate to indoleacetaldehyde. Enzymes having IPDA activity are classified as EC 4.1.1.74. An IPDA gene may be used to derive a gene encoding a polypeptide capable of catalyzing the conversion of OAA to malonate semialdehyde. This activity may be found in a native IPDA gene, or it may be derived by incorporating one or more mutations into a native IPDA gene. In certain embodiments, an indolepyruvate decarboxylase gene may be derived from a yeast, bacterial, or plant source.

A "pyruvate decarboxylase gene" or "PDC gene" as used herein refers to any gene that encodes a polypeptide with pyruvate decarboxylase activity, meaning the ability to catalyze the conversion of pyruvate to acetaldehyde. Enzymes having PDC activity are classified as EC 4.1.1.1. In preferred embodiments, a PDC gene that is incorporated into a modified yeast cell as provided herein has undergone one or more mutations versus the native gene from which it was derived such that the resultant gene encodes a polypeptide capable of catalyzing the conversion of OAA to malonate semialdehyde. In certain embodiments, a PDC gene may be derived from a yeast source. For example, a PDC gene may be derived from an *I. orientalis* PDC gene encoding the amino acid sequence set forth in SEQ ID NO: 49, an *S. cerevisiae* PDC1 gene encoding the amino acid sequence set forth in SEQ ID NO: 50, or a *K. lactis* PDC encoding the amino acid sequence set forth in SEQ ID NO: 51. In certain embodiments, a PDC gene derived from the *I. orientalis* PDC gene may comprise the nucleotide sequence set forth in SEQ ID NO: 48 or a nucleotide sequence with at least 50%, at least 60%, at least 70%, at least 80%, at least 85%, at least 90%, at least 95%, at least 97%, or at least 99% sequence identity to the nucleotide sequence set forth in SEQ ID NO: 48. In other embodiments, a PDC gene may be derived from a bacterial source. For example, a PDC gene may be derived from a *Z. mobilis* PDC gene encoding the amino acid sequence set forth in SEQ ID NO: 52 or an *A. pasteurianus* PDC gene encoding the amino acid sequence set forth in SEQ ID NO: 53.

A "benzoylformate decarboxylase" gene as used herein refers to any gene that encodes a polypeptide with benzoylformate decarboxylase activity, meaning the ability to catalyze the conversion of benzoylformate to benzaldehyde. Enzymes having benzoylformate decarboxylase activity are classified as EC 4.1.1.7. In preferred embodiments, a benzoylformate decarboxylase gene that is incorporated into a modified yeast cell as provided herein has undergone one or more mutations versus the native gene from which it was derived such that the resultant gene encodes a polypeptide capable of catalyzing the conversion of OAA to malonate semialdehyde. In certain embodiments, a benzoylformate decarboxylase gene may be derived from a bacterial source. For example, a benzoylformate decarboxylase gene may be derived from a *P. putida* mdlC gene encoding the amino acid sequence set forth in SEQ ID NO: 54, a *P. aeruginosa* mdlC gene encoding the amino acid sequence set forth in SEQ ID NO: 55, a *P. stutzeri* dpgB gene encoding the amino acid sequence set forth in SEQ ID NO: 56, or a *P. fluorescens* ilvB-1 gene encoding the amino acid sequence set forth in SEQ ID NO: 57.

An "OAA formatelyase gene" as used herein refers to any gene that encodes a polypeptide with OAA formatelyase activity, meaning the ability to catalyze the conversion of an acylate ketoacid to its corresponding CoA derivative. A polypeptide encoded by an OAA formatelyase gene may have activity on pyruvate or on another ketoacid. In certain embodiments, an OAA formatelyase gene encodes a polypeptide that converts OAA to malonyl-CoA.

A "malonyl-CoA reductase gene" as used herein refers to any gene that encodes a polypeptide with malonyl-CoA reductase activity, meaning the ability to catalyze the conversion of malonyl-CoA to malonate semialdehyde (also referred to as Co-A acylating malonate semialdehyde dehydrogenase activity). In certain embodiments, a malonyl-CoA reductase gene may be derived from a bifunctional malonyl-CoA reductase gene which also has the ability to catalyze the conversion of malonate semialdehyde to 3-HP. In certain of these embodiments, a malonyl-CoA reductase gene may be derived from a bacterial source. For example, a malonyl-CoA reductase gene may be derived from a *C. aurantiacus* malonyl-CoA reductase gene encoding the amino acid sequence set forth in SEQ ID NO: 58, an *R. castenholzii* malonyl-CoA reductase gene encoding the amino acid sequence set forth in SEQ ID NO: 59, or an *Erythrobacter* sp. NAP1 malonyl-CoA reductase gene encoding the amino acid sequence set forth in SEQ ID NO: 60. In other embodiments, a malonyl-CoA reductase gene may be derived from a malonyl-CoA reductase gene encoding a polypeptide that only catalyzes the conversion of malonyl-CoA to malonate semialdehyde. For example, a malonyl-CoA reductase gene may be derived from an *M. sedula* Msed_0709 gene encoding the amino acid sequence set forth in SEQ ID NO: 61 or a *S. tokodaii* malonyl-CoA reductase encoding the amino acid sequence set forth in SEQ ID NO: 62.

A "pyruvate dehydrogenase gene" or "PDH gene" as used herein refers to any gene that encodes a polypeptide with pyruvate dehydrogenase activity, meaning the ability to catalyze the conversion of pyruvate to acetyl-CoA. In certain embodiments, a PDH gene may be derived from a yeast source. For example, a PDH gene may be derived from an *S. cerevisiae* LAT1, PDA1, PDB1, or LPD gene encoding the amino acid sequence set forth in SEQ ID NOs: 63-66, respectively. In other embodiments, a PDH gene may be derived from a bacterial source. For example, a PDH gene may be derived from an *E. coli* strain K12 substr. MG1655 aceE, aceF, or lpd gene encoding the amino acid sequence set forth in SEQ ID NOs: 67-69, respectively, or a *B. subtilis* pdhA, pdhB, pdhC, or pdhD gene encoding the amino acid sequence set forth in SEQ ID NOs: 70-73, respectively.

An "acetyl-CoA carboxylase gene" or "ACC gene" as used herein refers to any gene that encodes a polypeptide with acetyl-CoA carboxylase activity, meaning the ability to catalyze the conversion of acetyl-CoA to malonyl-CoA. Enzymes having acetyl-CoA carboxylase activity are classified as EC 6.4.1.2. In certain embodiments, an acetyl-CoA carboxylase gene may be derived from a yeast source. For example, an acetyl-CoA carboxylase gene may be derived from an *S. cerevisiae* ACC1 gene encoding the amino acid sequence set forth in SEQ ID NO: 74. In other embodiments, an acetyl-CoA carboxylase gene may be derived from a bacterial source. For example, an acetyl-CoA carboxylase gene may be derived from an *E. coli* accA, accB, accC, or accD gene encoding the amino acid sequence set forth in SEQ ID NOs: 75-78, respectively, or a *C. aurantiacus* accA, accB, accC, or accD gene encoding the amino acid sequence set forth in SEQ ID NOs: 79-82, respectively.

An "alanine dehydrogenase gene" as used herein refers to any gene that encodes a polypeptide with alanine dehydrogenase activity, meaning the ability to catalyze the NAD-dependent reductive amination of pyruvate to alanine. Enzymes having alanine dehydrogenase activity are classified as EC 1.4.1.1. In certain embodiments, an alanine dehydrogenase gene may be derived from a bacterial source. For example, an alanine dehydrogenase gene may be derived from a *B. subtilis* alanine dehydrogenase gene encoding the amino acid sequence set forth in SEQ ID NO: 83.

A "pyruvate/alanine aminotransferase gene" as used herein refers to any gene that encodes a polypeptide with pyruvate/alanine aminotransferase activity, meaning the ability to catalyze the conversion of pyruvate and L-glutamate to alanine and 2-oxoglutarate. In certain embodiments, a pyruvate/alanine aminotransferase gene is derived from a yeast source. For example, a pyruvate/alanine aminotransferase gene may be derived from an *S. pombe* pyruvate/alanine aminotransferase gene encoding the amino acid sequence set forth in SEQ ID NO: 84 or an *S. cerevisiae* ALT2 gene encoding the amino acid sequence set forth in SEQ ID NO: 85.

An "alanine 2,3 aminomutase gene" or "AAM gene" as used herein refers to a gene that encodes a polypeptide with alanine 2,3 aminomutase activity, meaning the ability to catalyze the conversion of alanine to β-alanine. Alanine 2,3 aminomutase activity is not known to occur naturally. Therefore, an alanine 2,3 aminomutase gene can be derived by incorporating one or more mutations into a native source gene that encodes a polypeptide with similar activity such as lysine 2,3 aminomutase activity (see, e.g., U.S. Pat. No. 7,309,597). In certain embodiments, the native source gene may be a *B. subtilis* lysine 2,3 aminomutase gene encoding the amino acid sequence set forth in SEQ ID NO: 86, a *P. gingivalis* lysine 2,3 aminomutase gene encoding the amino acid sequence set forth in SEQ ID NO: 87, or a *F. nucleatum* (ATCC-10953) lysine 2,3 aminomutase gene encoding the amino acid sequence set forth in SEQ ID NO: 88.

A "CoA transferase gene" as used herein refers to any gene that encodes a polypeptide with CoA transferase activity, which in one example includes the ability to catalyze the conversion of β-alanine to β-alanyl-CoA and/or the conversion of lactate to lactyl-CoA. In certain embodiments, a CoA transferase gene may be derived from a yeast source. In other embodiments, a CoA transferase gene may be derived from a bacterial source. For example, a CoA transferase gene may be derived from an *M. elsdenii* CoA transferase gene encoding the amino acid sequence set forth in SEQ ID NO: 89.

A "CoA synthetase gene" as used herein refers to any gene that encodes a polypeptide with CoA synthetase activity. In one example this includes the ability to catalyze the conversion of β-alanine to β-alanyl-CoA. In another example, this includes the ability to catalyze the conversion of lactate to lactyl-CoA. In certain embodiments, a CoA synthetase gene may be derived from a yeast source. For example, a CoA synthetase gene may be derived from an *S. cerevisiae* CoA synthetase gene. In other embodiments, a CoA synthetase gene may be derived from a bacterial source. For example, a CoA synthetase gene may be derived from an *E. coli* CoA synthetase, *R. sphaeroides*, or *S. enterica* CoA synthetase gene.

A "β-alanyl-CoA ammonia lyase gene" as used herein refers to any gene that encodes a polypeptide with β-alanyl-CoA ammonia lyase activity, meaning the ability to catalyze the conversion of β-alanyl-CoA to acrylyl-CoA. In certain embodiments, a β-alanyl-CoA ammonia lyase gene may be derived from a bacterial source, such as a *C. propionicum* β-alanyl-CoA ammonia lyase gene encoding the amino acid sequence set forth in SEQ ID NO: 90.

A "3-HP-CoA dehydratase gene" or "acrylyl-CoA hydratase gene" as used herein refers to any gene that encodes a polypeptide with 3-HP-CoA dehydratase gene activity, meaning the ability to catalyze the conversion of acrylyl-CoA to 3-HP-CoA. Enzymes having 3-HP-CoA dehydratase activity are classified as EC 4.2.1.116. In certain embodiments, a 3-HP-CoA dehydratase gene may be derived from a yeast or fungal source, such as a *P. sojae* 3-HP-CoA dehydratase gene encoding the amino acid sequence set forth in SEQ ID NO: 91. In other embodiments, a 3-HP-CoA dehydratase gene may be derived from a bacterial source. For example, a 3-HP-CoA dehydratase gene may be derived from a *C. aurantiacus* 3-HP-CoA dehydratase gene encoding the amino acid sequence set forth in SEQ ID NO: 92, an *R. rubrum* 3-HP-CoA dehydratase gene encoding the amino acid sequence set forth in SEQ ID NO: 93, or an *R. capsulates* 3-HP-CoA dehydratase gene encoding the amino acid sequence set forth in SEQ ID NO: 94. In still other embodiments, a 3-HP-CoA dehydratase gene may be derived from a mammalian source. For example, a 3-HP-CoA dehydratase gene may be derived from a *H. sapiens* 3-HP-CoA dehydratase gene encoding the amino acid sequence set forth in SEQ ID NO: 95.

A "3-HP-CoA hydrolase gene" as used herein refers to any gene that encodes a polypeptide with 3-HP-CoA hydrolase activity, meaning the ability to catalyze the conversion of 3-HP-CoA to 3-HP. In certain embodiments, a 3-HP-CoA gene may be derived from a yeast or fungal source. In other embodiments, a 3-HP-CoA gene may be derived from a bacterial or mammalian source.

A "3-hydroxyisobutyryl-CoA hydrolase gene" as used herein refers to any gene that encodes a polypeptide with 3-hydroxyisobutyryl-CoA hydrolase activity, which in one example includes the ability to catalyze the conversion of 3-HP-CoA to 3-HP. In certain embodiments, a 3-hydroxyisobutyryl-CoA hydrolase gene may be derived from a bacterial source, such as a *P. fluorescens* 3-hydroxyisobutyryl-CoA hydrolase gene encoding the amino acid sequence set forth in SEQ ID NO: 96 or a *B. cereus* 3-hydroxyisobutyryl-CoA hydrolase gene encoding the amino acid sequence set forth in SEQ ID NO: 97. In other embodiments, a 3-hydroxyisobutyryl-CoA hydrolase gene may be derived from a mammalian source, such as a *H. sapiens* 3-hydroxyisobutyryl-CoA hydrolase gene encoding the amino acid sequence set forth in SEQ ID NO: 98.

A "lactate dehydrogenase gene" or "LDH gene" as used herein refers to any gene that encodes a polypeptide with lactate dehydrogenase activity, meaning the ability to catalyze the conversion of pyruvate to lactate. In certain embodiments, an LDH gene may be derived from a fungal, bacterial, or mammalian source.

A "lactyl-CoA dehydratase gene" as used herein refers to any gene that encodes a polypeptide with lactyl-CoA dehydratase activity, meaning the ability to catalyze the conversion of lactyl-CoA to acrylyl-CoA. In certain embodiments, a lactyl-CoA dehydratase gene may be derived from a bacterial source. For example, a lactyl-CoA dehydratase gene may be derived from an *M. elsdenii* lactyl-CoA dehydratase E1, EIIa, or EIIb subunit gene encoding the amino acid sequence set forth in SEQ ID NOs: 99-101.

An "aldehyde dehydrogenase gene" as used herein refers to any gene that encodes a polypeptide with aldehyde dehydrogenase activity, which in one example includes the ability to catalyze the conversion of 3-HPA to 3-HP and vice versa. In certain embodiments, an aldehyde dehydrogenase gene may be derived from a yeast source, such as an *S. cerevisiae* aldehyde dehydrogenase gene encoding the amino acid sequence set forth in SEQ ID NO: 102 or an *I. orientalis* aldehyde dehydrogenase gene encoding the amino acid sequence set forth in SEQ ID NOs: 122, 124, or 126. In other embodiments, an aldehyde dehydrogenase may be derived from a bacterial source, such as an *E. coli* aldH gene encoding the amino acid sequence set forth in SEQ ID NO: 103 or a *K. pneumoniae* aldehyde dehydrogenase gene encoding the amino acid sequence set forth in SEQ ID NO: 104.

A "glycerol dehydratase gene" as used herein refers to any gene that encodes a polypeptide with glycerol dehydratase activity, meaning the ability to catalyze the conversion of glycerol to 3-HPA. In certain embodiments, a glycerol dehydratase gene may be derived from a bacterial source, such as a *K. pneumonia* or *C. freundii* glycerol dehydratase gene.

The enzymes of the selected active 3-HP pathway, and activities thereof, can be detected using methods known in the art or as described herein. These detection methods may include use of specific antibodies, formation of an enzyme product, or disappearance of an enzyme substrate. See, for example, Sambrook et al., *Molecular Cloning: A Laboratory Manual*, Third Ed., Cold Spring Harbor Laboratory, New York (2001); Ausubel et al., *Current Protocols in Molecular*

*Biology*, John Wiley and Sons, Baltimore, Md. (1999); and Hanai et al., *Appl. Environ. Microbiol.* 73:7814-7818 (2007)).

Hosts, Expression Vectors and Nucleic Acid Constructs

The recombinant yeast cell may be any yeast cell capable of having an active 3-HP pathway. Those skilled in the art will understand that the genetic alterations, including metabolic modifications exemplified herein, may be described with reference to a suitable host organism such as *I. orientalis* and their corresponding metabolic reactions or a suitable source organism for desired genetic material such as genes for a desired metabolic pathway. However, given the complete genome sequencing of a wide variety of organisms and the high level of skill in the area of genomics, those skilled in the art can apply the teachings and guidance provided herein to other yeast organisms. For example, the *I. orientalis* metabolic alterations exemplified herein can readily be applied to other species by incorporating the same or analogous encoding nucleic acid from species other than the referenced species.

"Yeast" as used herein includes ascosporogenous yeast (Endomycetales), basidiosporogenous yeast, and yeast belonging to the Fungi Imperfecti (Blastomycetes). Since the classification of yeast may change in the future, for the purposes described herein, yeast shall be defined as described in *Biology and Activities of Yeast* (Skinner, F. A., Passmore, S. M., and Davenport, R. R., eds, *Soc. App. Bacteriol. Symposium Series* No. 9, 1980).

The yeast host cell may be a *Candida, Hansenula, Kluyveromyces, Pichia, Saccharomyces, Schizosaccharomyces, Yarrowia,* or *Issatchenkia* cell, such as a *Candida sonorensis, Candida methanosorbosa, Candida ethanolica, Kluyveromyces lactis, Kluyveromyces marxianus, Pichia fermentans, Pichia galeiformis, Pichia membranifaciens, Pichia deserticola, Saccharomyces carlsbergensis, Saccharomyces cerevisiae, Saccharomyces diastaticus, Saccharomyces bulderi, Saccharomyces douglasii, Saccharomyces kluyveri, Saccharomyces norbensis, Saccharomyces oviformis, Yarrowia lipolytica* or *Issatchenkia orientalis* cell.

The yeast host cell may be derived from a cell or engineered such that the cell has been genetically modified to produce high lactic acid titers, exhibit increased tolerance to acidic pH, exhibit increased tolerance to ethanol or propanol, and/or display increased ability to ferment pentose sugars (yet, in some embodiments, the yeast cell is unable to ferment pentose sugars). Exemplary genetically modified yeast cells are described in WO00/71738, WO03/049525, WO03/102201, WO03/102152, WO02/42471, WO2007/032792, WO2007/106524, WO2007/117282, the content of which is hereby incorporated by reference with respect to said cells. The modification of any yeast cell described in the foregoing applications is contemplated with an active 3-HP pathway as described herein.

The yeast host cell may be a crabtree-positive phenotype or a crabtree-negative phenotype. Crabtree-negative organisms are characterized by the ability to be induced into an increased fermentative state. Both naturally occurring organisms and recombinant organisms can be characterized as Crabtree-negative. The Crabtree effect is defined as oxygen consumption inhibition in a microorganism when the microorganism is cultured under aerobic conditions in the presence of a high concentration of glucose (e.g. >5 mM glucose). Crabtree-positive organisms continue to ferment (rather than respire) irrespective of oxygen availability in the presence of glucose, while Crabtree-negative organisms do not exhibit glucose-mediated inhibition of oxygen consumption. This characteristic is useful for organic product synthesis, since it permits cells to be grown at high substrate concentrations but to retain the beneficial energetic effects of oxidative phosphorylation. In one aspect, the yeast has a crabtree-negative phenotype.

In certain embodiments, the yeast cells provided herein are 3-HP resistant yeast cells, as described in US2012/0135481. A "3-HP-resistant yeast cell" as used herein refers to a yeast cell that exhibits an average glycolytic rate of at least 2.5 g/L/hr in media containing 75 g/L or greater 3-HP at a pH of less than 4.0. Such rates and conditions represent an economic process for producing 3-HP. In certain of these embodiments, the yeast cells may exhibit 3-HP resistance in their native form. In other embodiments, the cells may have undergone mutation and/or selection (e.g., chemostat selection or repeated serial subculturing) before, during, or after introduction of genetic modifications related to an active 3-HP pathway, such that the mutated and/or selected cells possess a higher degree of resistant to 3-HP than wild-type cells of the same species. For example, in some embodiments, the cells have undergone mutation and/or selection in the presence of 3-HP or lactic acid before being genetically modified with one or more heterologous 3-HP pathway genes. In certain embodiments, mutation and/or selection may be carried out on cells that exhibit 3-HP resistance in their native form. Cells that have undergone mutation and/or selection may be tested for sugar consumption and other characteristics in the presence of varying levels of 3-HP in order to determine their potential as industrial hosts for 3-HP production. In addition to 3-HP resistance, the yeast cells provided herein may have undergone mutation and/or selection for resistance to one or more additional organic acids (e.g., lactic acid) or to other fermentation products, byproducts, or media components.

Selection, such as selection for resistance to 3-HP or to other compounds, may be accomplished using methods well known in the art. For example, as mentioned supra, selection may be chemostat selection. Chemostat selection uses a chemostat that allows for a continuous culture of microorganisms (e.g., yeast) wherein the specific growth rate and cell number can be controlled independently. A continuous culture is essentially a flow system of constant volume to which medium is added continuously and from which continuous removal of any overflow can occur. Once such a system is in equilibrium, cell number and nutrient status remain constant, and the system is in a steady state. A chemostat allows control of both the population density and the specific growth rate of a culture through dilution rate and alteration of the concentration of a limiting nutrient, such as a carbon or nitrogen source. By altering the conditions as a culture is grown (e.g., decreasing the concentration of a secondary carbon source necessary to the growth of the inoculum strain, among others), microorganisms in the population that are capable of growing faster at the altered conditions will be selected and will outgrow microorganisms that do not function as well under the new conditions. Typically such selection requires the progressive increase or decrease of at least one culture component over the course of growth of the chemostat culture. The operation of chemostats and their use in the directed evolution of microorganisms is well known in the art (see, e.g., Novick Proc Natl Acad Sci USA 36:708-719 (1950), Harder J Appl Bacteriol 43:1-24 (1977). Other methods for selection include, but are not limited to, repeated serial subculturing under the selective conditions as described in e.g., U.S. Pat. No. 7,629,162. Such methods can be used in place of, or in addition to, using the glucose limited chemostat method described above.

Yeast strains exhibiting the best combinations of growth and glucose consumption in 3-HP media as disclosed in, e.g., US2012/0135481, are preferred host cells for various genetic modifications relating to 3-HP pathways. Yeast genera that possess the potential for a relatively high degree of 3-HP resistance, as indicated by growth in the presence of 75 g/L 3-HP or higher at a pH of less than 4, include for example *Candida, Kluyveromyces, Issatchenkia, Saccharomyces, Pichia, Schizosaccharomyces, Torulaspora,* and *Zygosaccharomyces*. Species exhibiting 3-HP resistance included *I. orientalis* (also known as *C. krusei*), *C. lambica* (also known as *Pichia fermentans*), and *S. bulderi* (also known as *Kazachstania bulderi*). *I. orientalis* and *C. lambica* are from the *I. orientalis/P. fermentans* clade, while *S. bulderi* is from the *Saccharomyces* clade. Specific strains exhibiting 3-HP resistance included *I. orientalis* strains 24210, PTA-6658, 60585, and CD1822, *S. bulderi* strains MYA-402 and MYA-404, and *C. lambica* strain ATCC 38617.

Other wild-type yeast or fungi may be tested in a similar manner and identified to have acceptable levels of growth and glucose utilization in the presence of high levels of 3-HP as described herein. For example, Gross and Robbins (Hydrobiologia 433(103):91-109) have compiled a list of 81 fungal species identified in low pH (<4) environments that could be relevant to test as potential production hosts.

In certain embodiments, the modified yeast cells provided herein are generated by incorporating one or more genetic modifications into a Crabtree-negative host yeast cell. In certain of these embodiments the host yeast cell belongs to the genus *Issatchenkia, Candida,* or *Saccharomyces*, and in certain of these embodiments the host cell belongs to the *I. orientalis/P. fermentans* or *Saccharomyces* clade. In certain of embodiments, the host cell is *I. orientalis* or *C. lambica*, or *S. bulderi*.

The *I. orientalis/P. fermentans* clade is the most terminal clade that contains at least the species *I. orientalis, P. galeiformis, P.* sp.YB-4149 (NRRL designation), *C. ethanolica, P. deserticola, P. membranifaciens,* and *P. fermentans*. Members of the *I. orientalis/P. fermentans* clade are identified by analysis of the variable D1/D2 domain of the 26S ribosomal DNA of yeast species, using the method described by Kurtzman and Robnett in "Identification and Phylogeny of Ascomycetous Yeasts from Analysis of Nuclear Large Subunit (26S) Ribosomal DNA Partial Sequences," *Antonie van Leeuwenhoek* 73:331-371, 1998, incorporated herein by reference (see especially p. 349). Analysis of the variable D1/D2 domain of the 26S ribosomal DNA from hundreds of ascomycetes has revealed that the *I. orientalis/P. fermentans* clade contains very closely related species. Members of the *I. orientalis/P. fermentans* clade exhibit greater similarity in the variable D1/D2 domain of the 26S ribosomal DNA to other members of the clade than to yeast species outside of the clade. Therefore, other members of the *I. orientalis/P. fermentans* clade can be identified by comparison of the D1/D2 domains of their respective ribosomal DNA and comparing to that of other members of the clade and closely related species outside of the clade, using Kurtzman and Robnett's methods.

In certain embodiments, the recombinant yeast cells provided herein belong to the genus *Issatchenkia*, and in certain of these embodiments the yeast cells are *I. orientalis*. When first characterized, the species *I. orientalis* was assigned the name *Pichia kudriavzevii*. The anamorph (asexual form) of *I. orientalis* is known as *Candida krusei*. Numerous additional synonyms for the species *I. orientalis* have been listed elsewhere (Kurtzman and Fell, The Yeasts, a Taxonomic Study. Section 35. *Issatchenkia Kudryavtsev,* pp 222-223 (1998)).

In certain embodiments, the yeast cells are *I. orientalis* CNB1 yeast cells. *I. orientalis* CNB1 yeast cells are described in WO2012/074818 (the content of which is incorporated herein by reference) and include the *I. orientalis* CNB1 yeast cells described therein and any yeast cells derived from the *I. orientalis* CNB1 yeast cells described therein.

The ideal yeast cell for 3-HP production is capable of growing at low pH levels. The ability to conduct fermentation at a low pH decreases downstream recovery costs, resulting in more economical production. Therefore, in certain embodiments the yeast host cell is capable of growing at low pH levels (e.g., at pH levels less than 7, 6, 5, 4, or 3).

A suitable host cell may possess one or more favorable characteristics in addition to 3-HP resistance and/or low pH growth capability. For example, potential host cells exhibiting 3-HP resistance may be further selected based on glycolytic rates, specific growth rates, thermotolerance, tolerance to biomass hydrolysate inhibitors, overall process robustness, and so on. These criteria may be evaluated prior to any genetic modification relating to a 3-HP pathway, or they may be evaluated after one or more such modifications have taken place.

Because most yeasts naturally produce ethanol, elimination or severe reduction in the enzyme catalyzing the first step in ethanol production from pyruvate (PDC) is favored for sufficient yield of an alternate product. In Crabtree-positive yeast such as *Saccharomyces*, a disrupted PDC gene causes the host to acquire an auxotrophy for two-carbon compounds such as ethanol or acetate, and causes a lack of growth in media containing glucose. Mutants capable of overcoming these limitations can be obtained using progressive selection for acetate independence and glucose tolerance (see, e.g., van Maris Appl Environ Microbiol 70:159 (2004)). Therefore, in certain embodiments a preferred yeast host cell is a Crabtree-negative yeast cell, in which PDC-disrupted strains are able to grow on glucose and retain C2 prototrophy. A more detailed discussion of gene disruptions is shown below.

In some aspects, the yeast cell comprises one or more (e.g., two, several) heterologous polynucleotides of an active 3-HP pathway described herein (e.g., a heterologous polynucleotide encoding a PPC; a heterologous polynucleotide encoding a PYC; a heterologous polynucleotide encoding an AAT; a heterologous polynucleotide encoding an ADC; a heterologous polynucleotide encoding a BAAT or gabT; and/or a heterologous polynucleotide encoding a 3-HPDH), wherein the yeast cell secretes (and/or is capable of secreting) an increased level of 3-HP compared to the host cell without the one or more heterologous polynucleotides of the active 3-HP pathway when cultivated under the same conditions. In some aspects, the yeast cell secretes and/or is capable of secreting an increased level of 3-HP of at least 5%, e.g., at least 10%, at least 15%, at least 20%, at least 25%, at least 50%, at least 100%, at least 150%, at least 200%, at least 300%, or at least 500% compared to the host cell without the one or more heterologous polynucleotides of the active 3-HP pathway, when cultivated under the same conditions. Examples of suitable cultivation conditions are described below and will be readily apparent to one of skill in the art based on the teachings herein.

In any of these aspects, the recombinant yeast cell produces (and/or is capable of producing) 3-HP at a yield of at least 10%, e.g., at least 20%, at least 30%, at least 40%, at least 50%, at least 60%, at least 70%, at least 80%, or at least 90%, of theoretical.

In any of these aspects, the recombinant yeast cell has a 3-HP volumetric productivity greater than about 0.1 g/L per hour, e.g., greater than about 0.2 g/L per hour, 0.5 g/L per hour, 0.6 g/L per hour, 0.7 g/L per hour, 0.8 g/L per hour, 0.9 g/L per hour, 1.0 g/L per hour, 1.1 g/L per hour, 1.2 g/L per hour, 1.3 g/L per hour, 1.5 g/L per hour, 1.75 g/L per hour, 2.0 g/L per hour, 2.25 g/L per hour, 2.5 g/L per hour, or 3.0 g/L per hour; or between about 0.1 g/L per hour and about 2.0 g/L per hour, e.g., between about 0.3 g/L per hour and about 1.7 g/L per hour, about 0.5 g/L per hour and about 1.5 g/L per hour, about 0.7 g/L per hour and about 1.3 g/L per hour, about 0.8 g/L per hour and about 1.2 g/L per hour, or about 0.9 g/L per hour and about 1.1 g/L per hour.

The recombinant yeast cells may be cultivated in a nutrient medium suitable for production of one or more polypeptides of the active 3-HP pathway using methods well known in the art. For example, the cell may be cultivated by shake flask cultivation, and small-scale or large-scale fermentation (including continuous, batch, fed-batch, or solid state fermentations) in laboratory or industrial fermentors performed in a suitable medium and under conditions allowing the desired polypeptide to be expressed and/or isolated. The cultivation takes place in a suitable nutrient medium comprising carbon and nitrogen sources and inorganic salts, as described herein, using procedures known in the art. Suitable media are available from commercial suppliers, may be prepared according to published compositions (e.g., in catalogues of the American Type Culture Collection), or may be prepared from commercially available ingredients.

The recombinant yeast cells described herein also can be subjected to adaptive evolution to further augment 3-HP biosynthesis, including under conditions approaching theoretical maximum growth.

The recombinant yeast cells described herein can further contain lipase or esterase activity, for example due to expression of a heterologous polynucleotide encoding a lipase or esterase (EC 3.1.1.-). Such cells can be used to produce an ester of 3-HP, such as methyl 3-hydroxypropionate, ethyl 3-hydroxypropionate, propyl 3-hydroxypropionate, butyl 3-hydroxypropionate, or 2-ethylhexyl 3-hydroxypropionate. The cells can further contain esterase activity, for example due to expression of a heterologous polynucleotide encoding an esterase. Such cells can be used to produce polymerized 3-HP. The cells can further contain alcohol dehydrogenase activity (EC 1.1.1.1), aldehyde dehydrogenase activity (EC 1.2.1.-), or both, for example due to expression of a heterologous polynucleotide encoding an alcohol dehydrogenase, aldehyde dehydrogenase, or both. Such cells can be used to produce 1,3-propanediol.

The recombinant yeast cells described herein may utilize expression vectors comprising the coding sequence of one or more (e.g., two, several) heterologous 3-HP pathway genes (e.g., the coding sequence of a PPC, PYC, AAT, ADC, BAAT, gabT, and/or 3-HPDH described herein) linked to one or more control sequences that direct expression in a suitable yeast cell under conditions compatible with the control sequence(s). Such expression vectors may be used in any of the yeast cells and methods described herein. The polynucleotides described herein may be manipulated in a variety of ways to provide for expression of a desired polypeptide. Manipulation of the polynucleotide prior to its insertion into a vector may be desirable or necessary depending on the expression vector. The techniques for modifying polynucleotides utilizing recombinant DNA methods are well known in the art.

A construct or vector (or multiple constructs or vectors) comprising the one or more (e.g., two, several) heterologous 3-HP pathway genes may be introduced into a yeast cell so that the construct or vector is maintained as a chromosomal integrant or as a self-replicating extra-chromosomal vector as described earlier.

The various nucleotide and control sequences may be joined together to produce a recombinant expression vector that may include one or more (e.g., two, several) convenient restriction sites to allow for insertion or substitution of the polynucleotide at such sites. Alternatively, the polynucleotide(s) may be expressed by inserting the polynucleotide(s) or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

In one aspect, each heterologous polynucleotide is contained on an independent vector. In one aspect, at least two of the heterologous polynucleotides are contained on a single vector. In one aspect, at least three of the heterologous polynucleotides are contained on a single vector. In one aspect, at least four of the heterologous polynucleotides are contained on a single vector. In one aspect, all the heterologous polynucleotides are contained on a single vector. Polynucleotides encoding heteromeric subunits of a protein complex may be contained in a single heterologous polynucleotide on a single vector or alternatively contained in separate heterologous polynucleotides on separate vectors.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the yeast cell, or a transposon, may be used.

The expression vector may contain any suitable promoter sequence that is recognized by a yeast cell for expression of a GAPN gene or any 3-HP pathway gene described herein. The promoter sequence contains transcriptional control sequences that mediate the expression of the polypeptide. The promoter may be any polynucleotide that shows transcriptional activity in the yeast cell of choice including mutant, truncated, and hybrid promoters, and may be obtained from genes encoding extracellular or intracellular polypeptides either homologous or heterologous to the cell.

Each heterologous polynucleotide described herein may be operably linked to a promoter that is foreign to the polynucleotide. For example, in one aspect, the heterologous polynucleotide encoding the GAPN is operably linked to a promoter foreign to the polynucleotide. In another aspect, the heterologous polynucleotide encoding a polypeptide of a 3-HP pathway described herein (e.g., a PPC, PYC, AAT, ADC, BAAT, gabT, or 3-HPDH) is operably linked to promoter foreign to the polynucleotide. The promoters may be identical to or share a high degree of sequence identity (e.g., at least about 80%, at least about 85%, at least about 90%, at least about 95%, or at least about 99%) with a selected native promoter.

Examples of suitable promoters for directing the transcription of the nucleic acid constructs in a yeast cells, include, but are not limited to, the promoters obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), *Saccharomyces cerevisiae* 3-phosphoglycerate kinase (PGK), PDC1, xylose reductase (XR), xylitol dehydrogenase (XDH), L-(+)-lactate-cytochrome c oxidoreductase (CYB2), translation elongation factor-1 (TEF1), translation elongation factor-2 (TEF2), glyceraldehyde-3-phosphate dehydrogenase (GAPDH), and orotidine 5'-phosphate decarboxylase (URA3) genes. Other useful promoters for yeast host cells are described by Romanos et al., 1992, *Yeast* 8: 423-488.

The control sequence may also be a suitable transcription terminator sequence, which is recognized by a host cell to terminate transcription. The terminator sequence is operably linked to the 3'-terminus of the polynucleotide encoding the polypeptide. Any terminator that is functional in the yeast cell of choice may be used. The terminator may be identical to or share a high degree of sequence identity (e.g., at least about 80%, at least about 85%, at least about 90%, at least about 95%, or at least about 99%) with the selected native terminator. In certain embodiments, 3-HP pathway genes are linked to a terminator that comprises a functional portion of a native GAL10 gene native to the host cell or a sequence that shares at least 80%, at least 85%, at least 90%, or at least 95% sequence identity with a native GAL10 terminator.

Suitable terminators for yeast host cells are obtained from the genes for *Saccharomyces cerevisiae* enolase, *Saccharomyces cerevisiae* cytochrome C (CYC1), *Saccharomyces cerevisiae* glyceraldehyde-3-phosphate dehydrogenase (gpd), PDC1, XR, XDH, transaldolase (TAL), transketolase (TKL), ribose 5-phosphate ketol-isomerase (RKI), CYB2, and the galactose family of genes (especially the GAL10 terminator). Other useful terminators for yeast host cells are described by Romanos et al., 1992, supra.

The control sequence may also be a suitable leader sequence, when transcribed is a nontranslated region of an mRNA that is important for translation by the host cell. The leader sequence is operably linked to the 5'-terminus of the polynucleotide encoding the polypeptide. Any leader sequence that is functional in the yeast cell of choice may be used.

Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence; a sequence operably linked to the 3'-terminus of the polynucleotide and, when transcribed, is recognized by the host cell as a signal to add polyadenosine residues to transcribed mRNA. Any polyadenylation sequence that is functional in the host cell of choice may be used. Useful polyadenylation sequences for yeast cells are described by Guo and Sherman, 1995, *Mol. Cellular Biol.* 15: 5983-5990.

It may also be desirable to add regulatory sequences that allow the regulation of the expression of the polypeptide relative to the growth of the host cell. Examples of regulatory systems are those that cause the expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked with the regulatory sequence.

The vectors may contain one or more (e.g., two, several) selectable markers that permit easy selection of transformed, transfected, transduced, or the like cells. A selectable marker is a gene the product of which provides for biocide or viral resistance, resistance to heavy metals, prototrophy to auxotrophs, and the like. Suitable markers for yeast host cells include ADE2, HIS3, LEU2, LYS2, MET3, TRP1, and URA3.

The vectors may contain one or more (e.g., two, several) elements that permit integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the yeast cell. The origin of replication may be any plasmid replicator mediating autonomous replication that functions in a cell. The term "origin of replication" or "plasmid replicator" means a polynucleotide that enables a plasmid or vector to replicate in vivo. Examples of origins of replication for use in a yeast host cell are the 2 micron origin of replication, ARS1, ARS4, the combination of ARS1 and CEN3, and the combination of ARS4 and CEN6.

More than one copy of a polynucleotide described herein may be inserted into a host cell to increase production of a polypeptide. An increase in the copy number of the polynucleotide can be obtained by integrating at least one additional copy of the sequence into the yeast cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors described herein are well known to one skilled in the art (see, e.g., Sambrook et al., 1989, supra).

Additional procedures and techniques known in the art for the preparation of yeast cells comprising one or more 3-HP pathway genes, are described in, e.g., US2012/0135481, the content of which in hereby incorporated by reference.

Gene Disruptions

The recombinant yeast cell may also comprise one or more (e.g., two, several) gene disruptions, e.g., to divert sugar metabolism from undesired products to 3-HP. In some aspects, the recombinant host cells produce a greater amount of 3-HP compared to the cell without the one or more disruptions when cultivated under identical conditions. In some aspects, one or more of the disrupted endogenous genes are inactivated.

In certain embodiments, the recombinant yeast cells provided herein comprise a disruption of one or more endogenous genes encoding an enzyme involved in ethanol fermentation, including for example pyruvate decarboxylase (PDC, converts pyruvate to acetaldehyde) and/or alcohol dehydrogenase (ADH, converts acetaldehyde to ethanol) genes. These modifications decrease the ability of the yeast cell to produce ethanol, thereby maximizing 3-HP production. However, in certain embodiments the recombinant yeast cells provided herein may be engineered to co-produce 3-HP and ethanol. In those embodiments, endogenous genes encoding an enzyme involved in ethanol fermentation are preferably not disrupted, and in certain embodiments the yeast cells may comprise one or more heterologous genes that increase ethanol production.

In some embodiments, the recombinant yeast cells comprise a disruption to an endogenous gene encoding a PDC having at least 75%, e.g., at least 80%, at least 85%, at least 90%, at least 95%, at least 97%, at least 98%, at least 99%, or 100% sequence identity to SEQ ID NO: 186. In some embodiments, the endogenous gene encodes a PDC having an amino acid sequence comprising or consisting of SEQ ID NO: 186. In some embodiments, the coding sequence of the endogenous gene encoding the PDC has at least 75%, e.g., at least 80%, at least 85%, at least 90%, at least 95%, at least 97%, at least 98%, at least 99%, or 100% sequence identity to SEQ ID NO: 185. In some embodiments, the coding sequence of the endogenous gene encoding the PDC comprises or consists of SEQ ID NO: 185. In some embodiments, the endogenous gene encoding the PDC is inactivated.

In certain embodiments, the recombinant yeast cells provided herein comprise a disruption of one or more endogenous genes encoding an enzyme involved in producing alternate fermentative products such as glycerol or other byproducts such as acetate or diols. For example, the cells provided herein may comprise a disruption of one or more of glycerol 3-phosphate dehydrogenase (GPD, catalyzes reaction of dihydroxyacetone phosphate to glycerol 3-phosphate), glycerol 3-phosphatase (GPP, catalyzes conversion of glycerol-3 phosphate to glycerol), glycerol kinase (catalyzes conversion of glycerol 3-phosphate to glycerol), dihydroxyacetone kinase (catalyzes conversion of dihydroxyacetone phosphate to dihydroxyacetone), glycerol dehydrogenase (catalyzes conversion of dihydroxyacetone to glycerol), aldehyde dehydrogenase (ALD, e.g., converts acetaldehyde to acetate or 3-HP to 3-HPA), or butanediol dehydrogenase (catalyzes conversion of butanediol to acetoin and vice versa) genes.

In some embodiments, the recombinant yeast cells comprise a disruption to an endogenous gene encoding a GPD having at least 75%, e.g., at least 80%, at least 85%, at least 90%, at least 95%, at least 97%, at least 98%, at least 99%, or 100% sequence identity to SEQ ID NO: 188. In some embodiments, the endogenous gene encodes a GPD having an amino acid sequence comprising or consisting of SEQ ID NO: 188. In some embodiments, the coding sequence of the endogenous gene encoding the GPD has at least 75%, e.g., at least 80%, at least 85%, at least 90%, at least 95%, at least 97%, at least 98%, at least 99%, or 100% sequence identity to SEQ ID NO: 187. In some embodiments, the coding sequence of the endogenous gene encoding the GPD comprises or consists of SEQ ID NO: 187. In some embodiments, the endogenous gene encoding the GPD is inactivated.

In certain embodiments, the recombinant yeast cells provided herein comprise a disruption of one or more endogenous genes encoding an enzyme that catalyzes a reverse reaction in a 3-HP pathway, including for example PEP carboxykinase (PCK), enzymes with OAA decarboxylase activity, or CYB2A or CYB2B (catalyzes the conversion of lactate to pyruvate). PCK catalyzes the conversion of PEP to OAA and vice versa, but exhibits a preference for the OAA to PEP reaction. To reduce the conversion of OAA to PEP, one or more copies of a native PCK gene may be disrupted. In certain embodiments, yeast cells in which one or more native PCK genes have been disrupted may express one or more heterologous PCK genes that have been mutated to encode a polypeptide that favors the conversion of PEP to OAA. OAA decarboxylase catalyzes the conversion of OAA to pyruvate. Enzymes with OAA decarboxylase activity have been identified, such as that coded by the eda gene in *E. coli* and malic enzyme (MAE) in yeast and fungi. To reduce OAA decarboxylase activity, one or more copies of a native gene encoding an enzyme with OAA decarboxylase activity may be disrupted. In certain embodiments, yeast cells in which one or more native OAA decarboxylation genes have been disrupted may express one or more heterologous OAA decarboxylation genes that have been mutated to encode a polypeptide that catalyzes the conversion of pyruvate to OAA.

In certain embodiments, the recombinant yeast cells provided herein comprise a disruption of one or more endogenous genes encoding an enzyme involved in an undesirable reaction with a 3-HP pathway product or intermediate. Examples of such genes include those encoding an enzyme that converts 3-HP to an aldehyde of 3-HP, which are known to be toxic to certain cells.

In certain embodiments, the recombinant yeast cells provided herein comprise a disruption of one or more endogenous genes encoding an enzyme that has a neutral effect on a 3-HP pathway, including for example GALE (negative regulator of the GAL system that converts galactose to glucose). Disruption of neutral genes allows for insertion of one or more heterologous genes without affecting native pathways.

Modeling can also be used to design gene disruptions that additionally optimize utilization of the pathway (see, for example, U.S. patent publications US 2002/0012939, US 2003/0224363, US 2004/0029149, US 2004/0072723, US 2003/0059792, US 2002/0168654 and US 2004/0009466, and U.S. Pat. No. 7,127,379). Modeling analysis allows reliable predictions of the effects on cell growth of shifting the metabolism towards more efficient production of 3-HP. One exemplary computational method for identifying and designing metabolic alterations favoring biosynthesis of a desired product is the OptKnock computational framework, Burgard et al., Biotechnol. Bioeng. 84:647-657 (2003).

The recombinant yeast cells comprising a gene disruption may be constructed using methods well known in the art, including those methods described herein. A portion of the gene can be disrupted such as the coding region or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, but are not limited to, a leader, propeptide sequence, signal sequence, transcription terminator, and transcriptional activator.

The recombinant yeast cells comprising a gene disruption may be constructed by gene deletion techniques to eliminate or reduce expression of the gene. Gene deletion techniques enable the partial or complete removal of the gene thereby eliminating their expression. In such methods, deletion of the gene is accomplished by homologous recombination using a plasmid that has been constructed to contiguously contain the 5' and 3' regions flanking the gene.

The recombinant yeast cells comprising a gene disruption may also be constructed by introducing, substituting, and/or removing one or more (several) nucleotides in the gene or a control sequence thereof required for the transcription or translation thereof. For example, nucleotides may be inserted or removed for the introduction of a stop codon, the removal of the start codon, or a frame-shift of the open reading frame. Such a modification may be accomplished by site-directed mutagenesis or PCR generated mutagenesis in accordance with methods known in the art. See, for example, Botstein and Shortle, *Science* 1985, 229, 4719; Lo et al., *Proc. Natl. Acad. Sci. U.S.A.* 1985, 81, 2285; Higuchi et al., *Nucleic Acids Res* 1988, 16, 7351; Shimada, *Meth. Mol. Biol.* 1996, 57, 157; Ho et al., *Gene* 1989, 77, 61; Horton et al., *Gene* 1989, 77, 61; and Sarkar and Sommer, *BioTechniques* 1990, 8, 404.

The recombinant yeast cells comprising a gene disruption may also be constructed by inserting into the gene a disruptive nucleic acid construct comprising a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a non-functional gene product results. A disrupting construct may be simply a selectable marker gene accompanied by 5' and 3' regions homologous to the gene. The selectable marker enables identification of transformants containing the disrupted gene.

The recombinant yeast cells comprising a gene disruption may also be constructed by the process of gene conversion (see, for example, Iglesias and Trautner, *Molecular General Genetics* 1983, 189, 73-76). For example, in the gene conversion method, a nucleotide sequence corresponding to the gene is mutagenized in vitro to produce a defective nucleotide sequence, which is then transformed into the recombinant strain to produce a defective gene. By homologous recombination, the defective nucleotide sequence replaces the endogenous gene. It may be desirable that the defective nucleotide sequence also comprises a marker for selection of transformants containing the defective gene.

The recombinant yeast cells comprising a gene disruption may be further constructed by random or specific mutagenesis using methods well known in the art, including, but not limited to, chemical mutagenesis (see, for example, Hopwood, *The Isolation of Mutants in Methods in Microbiology* (J. R. Norris and D. W. Ribbons, eds.) pp. 363-433, Academic Press, New York, 1970). Modification of the gene may be performed by subjecting the parent strain to mutagenesis and screening for mutant strains in which expression of the gene has been reduced or inactivated. The mutagenesis, which may be specific or random, may be performed, for example, by use of a suitable physical or chemical mutagenizing agent, use of a suitable oligonucleotide, or subjecting the DNA sequence to PCR generated mutagenesis. Furthermore, the mutagenesis may be performed by use of any combination of these mutagenizing methods.

Examples of a physical or chemical mutagenizing agent suitable for the present purpose include ultraviolet (UV) irradiation, hydroxylamine, N-methyl-N'-nitro-N-nitrosoguanidine (MNNG), N-methyl-N'-nitrosoguanidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the parent strain to be mutagenized in the presence of the mutagenizing agent of choice under suitable conditions, and selecting for mutants exhibiting reduced or no expression of the gene.

A nucleotide sequence homologous or complementary to a gene described herein may be used from other microbial sources to disrupt the corresponding gene in a recombinant strain of choice.

In one aspect, the modification of a gene in the recombinant yeast cell is unmarked with a selectable marker. Removal of the selectable marker gene may be accomplished by culturing the mutants on a counter-selection medium. Where the selectable marker gene contains repeats flanking its 5' and 3' ends, the repeats will facilitate the looping out of the selectable marker gene by homologous recombination when the mutant strain is submitted to counter-selection. The selectable marker gene may also be removed by homologous recombination by introducing into the mutant strain a nucleic acid fragment comprising 5' and 3' regions of the defective gene, but lacking the selectable marker gene, followed by selecting on the counter-selection medium. By homologous recombination, the defective gene containing the selectable marker gene is replaced with the nucleic acid fragment lacking the selectable marker gene. Other methods known in the art may also be used.

Methods of Producing 3-HP and Related Compounds

The recombinant yeast cells described herein may be used for the production of 3-HP. In one aspect is a method of producing 3-HP, comprising: (a) cultivating any one of the recombinant yeast cells described herein (e.g., a recombinant host cell comprising an active 3-HP pathway and a heterologous polynucleotide encoding a GAPN) in a medium under suitable conditions to produce the 3-HP; and (b) recovering the 3-HP.

The recombinant yeast cells comprising an active 3-HP pathway may be cultivated in a nutrient medium suitable for 3-HP production using methods well known in the art. For example, the cells may be cultivated by shake flask cultivation, and small-scale or large-scale fermentation (including continuous, batch, fed-batch, or solid state fermentations) in laboratory or industrial fermentors performed in a suitable fermentation medium and under conditions allowing 3-HP production.

The recombinant yeast cells may produce 3-HP in a fermentable medium comprising any one or more (e.g., two, several) sugars, such as glucose, fructose, sucrose, cellobiose, xylose, xylulose, arabinose, mannose, galactose, and/or soluble oligosaccharides. The carbon source may be a twelve carbon sugar such as sucrose, a hexose sugar such as glucose or fructose, glycan or other polymer of glucose, glucose oligomers such as maltose, maltotriose and isomaltotriose, panose, and fructose oligomers. If the cell is modified to impart an ability to ferment pentose sugars, the fermentation medium may include a pentose sugar such as xylose, xylan or other oligomer of xylose, and/or arabinose. Such pentose sugars are suitably hydrolysates of a hemicellulose-containing biomass. In some embodiments, the cell is unable to ferment pentose sugars and/or the fermentable medium comprises less than 1% pentose sugars. In some instances, the fermentable medium is derived from a natural source, such as sugar cane, starch, or cellulose, and may be the result of pretreating the source by enzymatic hydrolysis (saccharification). In some aspects, the fermentable medium comprises sugar cane juice. Suitable media are available from commercial suppliers, may be prepared according to published compositions (e.g., in catalogues of the American Type Culture Collection), or may be prepared from commercially available ingredients.

In addition to the appropriate carbon sources from one or more (e.g., two, several) sugar(s), the fermentable medium may contain other nutrients or stimulators known to those skilled in the art, such as macronutrients (e.g., nitrogen sources) and micronutrients (e.g., vitamins, mineral salts, and metallic cofactors). In some aspects, the carbon source can be preferentially supplied with at least one nitrogen source, such as yeast extract, $N_2$, peptone (e.g., Bacto™ Peptone), or soytone (e.g., Bacto™ Soytone). Non-limiting examples of vitamins include multivitamins, biotin, pantothenate, nicotinic acid, meso-inositol, thiamine, pyridoxine, para-aminobenzoic acid, folic acid, riboflavin, and Vitamins A, B, C, D, and E. Examples of mineral salts and metallic cofactors include, but are not limited to Na, P, K, Mg, S, Ca, Fe, Zn, Mn, Co, and Cu.

In some embodiments, the recombinant yeast cells of the invention can be cultured in a chemically defined medium. In one example, the medium contains around 5 g/L ammonium sulfate, around 3 g/L potassium dihydrogen phosphate, around 0.5 g/L magnesium sulfate, trace elements, and vitamins and around 150 g/L glucose. The pH may be allowed to range freely during cultivation, or may be buffered if necessary to prevent the pH from falling below or rising above predetermined levels. In certain embodiments, the fermentation medium is inoculated with sufficient yeast cells that are the subject of the evaluation to produce an $OD_{600}$ of about 1.0. Unless explicitly noted otherwise, $OD_{600}$ as used herein refers to an optical density measured at a wavelength of 600 nm with a 1 cm pathlength using a model DU600 spectrophotometer (Beckman Coulter).

Specific conditions used for the methods of 3-HP production may be determined by one skilled in the art in light of the teachings herein. In some aspects of the methods, the yeast cells are cultivated for about 12 hours to about 216 hours, such as about 24 hours to about 144 hours, or about 36 hours to about 96 hours. The temperature is typically between about 26° C. to about 60° C., e.g., about 34° C. to about 50° C.

Cultivation may be performed under anaerobic, substantially anaerobic (microaerobic), or aerobic conditions, as appropriate. Briefly, anaerobic refers to an environment devoid of oxygen, substantially anaerobic (microaerobic) refers to an environment in which the concentration of oxygen is less than air, and aerobic refers to an environment wherein the oxygen concentration is approximately equal to or greater than that of the air. Substantially anaerobic conditions include, for example, a culture, batch fermentation or continuous fermentation such that the dissolved oxygen concentration in the medium remains less than 10% of saturation. Substantially anaerobic conditions also includes growing or resting cells in liquid medium or on solid agar inside a sealed chamber maintained with an atmosphere of less than 1% oxygen. The percent of oxygen can be maintained by, for example, sparging the culture with an $N_2/CO_2$ mixture or other suitable non-oxygen gas or gases. In some embodiments, the cultivation is performed under anaerobic conditions or substantially anaerobic conditions.

In one example, the concentration of cells in the fermentation medium is typically in the range of about 0.1 to 20, preferably from 0.1 to 5, even more preferably from 1 to 3 g dry cells/liter of fermentation medium during the production phase. If desired, oxygen uptake rate (OUR) can be varied throughout fermentation as a process control (see, e.g., WO03/102200). In some embodiments, the recombinant yeast cells provided herein are cultivated under microaerobic conditions characterized by an oxygen uptake rate from 2 to 45 mmol/L/hr, e.g., 2 to 25, 2 to 20, 2 to 15, 2 to 10, 10 to 45, 15 to 40, 20 to 35, or 25 to 35 mmol/L/hr. In certain embodiments, the recombinant yeast cells provided herein may perform especially well when cultivated under microaerobic conditions characterized by an oxygen uptake rate of from 2 to 25 mmol/L/hr. The medium may be buffered during the production phase such that the pH is maintained in a range of about 3.0 to about 7.0, or from about 4.0 to about 6.0. Suitable buffering agents are basic materials that neutralize the acid as it is formed, and include, for example, calcium hydroxide, calcium carbonate, sodium hydroxide, potassium hydroxide, potassium carbonate, sodium carbonate, ammonium carbonate, ammonia, ammonium hydroxide and the like. In general, those buffering agents that have been used in conventional fermentation processes are also suitable here.

In those embodiments where a buffered fermentation is utilized, acidic fermentation products may be neutralized to the corresponding salt as they are formed. In these embodiments, recovery of the acid involves regeneration of the free acid. This may be done by removing the cells and acidulating the fermentation broth with a strong acid such as sulfuric acid. This results in the formation of a salt by-product. For example, where a calcium salt is utilized as the neutralizing agent and sulfuric acid is utilized as the acidulating agent, gypsum is produced as a salt by-product. This by-product is separated from the broth, and the acid is recovered using techniques such as liquid-liquid extraction, distillation, absorption, and others (see, e.g., T. B. Vickroy, Vol. 3, Chapter 38 of *Comprehensive Biotechnology*, (ed. M. Moo-Young), Pergamon, Oxford, 1985; R. Datta, et al., FEMS Microbiol Rev, 1995, 16:221-231; U.S. Pat. Nos. 4,275,234, 4,771,001, 5,132,456, 5,420,304, 5,510,526, 5,641,406, and 5,831,122, and WO93/00440.

In other embodiments, the pH of the fermentation medium may be permitted to drop during cultivation from a starting pH that is at or above the pKa of 3-HP, typically 4.5 or higher, to at or below the pKa of the acid fermentation product, e.g., less than 4.5 or 4.0, such as in the range of about 1.5 to about 4.5, in the range of from about 2.0 to about 4.0, or in the range from about 2.0 to about 3.5.

In still other embodiments, fermentation may be carried out to produce a product acid by adjusting the pH of the fermentation broth to at or below the pKa of the product acid prior to or at the start of the fermentation process. The pH may thereafter be maintained at or below the pKa of the product acid throughout the cultivation. In certain embodiments, the pH may be maintained at less than 4.5 or 4.0, such as in a range of about 1.5 to about 4.5, in a range of about 2.0 to about 4.0, or in a range of about 2.0 to about 3.5.

The methods described herein can employ any suitable fermentation operation mode. For example, batch mode fermentation may be used with a close system where culture media and recombinant yeast, set at the beginning of fermentation, have no additional input except for the reagents certain reagents, e.g., for pH control, foam control or others required for process sustenance. The process described herein can also be employed in Fed-batch or continuous mode, as mentioned supra.

The methods described herein may be practiced in several bioreactor configurations, such as stirred tank, bubble column, airlift reactor and others known to those skilled in the art. The methods may be performed in free cell culture or in immobilized cell culture as appropriate. Any material support for immobilized cell culture may be used, such as alginates, fibrous bed, or argyle materials such as chrysotile, montmorillonite KSF and montmorillonite K-10.

In one aspect of the methods, the 3-HP is produced at a titer greater than about 5 g/L, e.g., greater than about 10 g/L, 25 g/L, 50 g/L, 75 g/L, 100 g/L, 125 g/L, 150 g/L, 160 g/L, 170 g/L, 180 g/L, 190 g/L, 200 g/L, 210 g/L, 225 g/L, 250 g/L, 275 g/L, 300 g/L, 325 g/L, 350 g/L, 400 g/L, or 500 g/L; or between about 10 g/L and about 500 g/L, e.g., between about 50 g/L and about 350 g/L, about 100 g/L and about 300 g/L, about 150 g/L and about 250 g/L, about 175 g/L and about 225 g/L, or about 190 g/L and about 210 g/L. In one embodiment, the 3-HP is produced at a titer greater than about 0.01 gram per gram of carbohydrate, e.g., greater than about 0.02, 0.05, 0.75, 0.1, 0.2, 0.3, 0.4, 0.5, 0.6, 0.7, 0.8, 0.9, or 1.0 gram per gram of carbohydrate.

In one aspect of the methods, the amount of produced 3-HP is at least 5%, e.g., at least 10%, at least 15%, at least 20%, at least 25%, at least 30%, at least 50%, or at least 100% greater compared to cultivating the recombinant yeast cell without the heterologous polynucleotide encoding the GAPN when cultivated under the same conditions.

In certain embodiments of the methods provided herein, the recombinant yeast cells produce relatively low levels of ethanol. In certain embodiments, ethanol may be produced in a yield of 10% or less, preferably in a yield of 2% or less. In certain of these embodiments, ethanol is not detectably produced. In other embodiments, however, 3-HP and ethanol may be co-produced. In these embodiments, ethanol may be produced at a yield of greater than 10%, greater than 25%, or greater than 50%.

The 3-HP can be optionally recovered from the fermentation medium using any procedure known in the art including, but not limited to, chromatography (e.g., size exclusion chromatography, adsorption chromatography, ion exchange chromatography), electrophoretic procedures, differential solubility, osmosis, distillation, extraction (e.g., liquid-liquid extraction), pervaporation, extractive filtration, membrane filtration, membrane separation, reverse, or ultrafiltration. In one aspect, the 3-HP is separated from other fermented material and purified by conventional methods of distillation. Accordingly, in one aspect, the method further comprises purifying the recovered 3-HP by distillation.

The recombinant 3-HP may also be purified by the chemical conversion of impurities (contaminants) to products more easily removed from 3-HP by the procedures described above (e.g., chromatography, electrophoretic procedures, differential solubility, distillation, or extraction) and/or by direct chemical conversion of impurities to 3-HP. For example, in one aspect, the method further comprises purifying the recovered 3-HP by converting δ-alanine contaminant to 3-HP, using chemical techniques known in the art.

In some aspects of the methods, the recombinant 3-HP preparation before and/or after being optionally purified is substantially pure. With respect to the methods of producing 3-HP, "substantially pure" intends a recovered preparation that contains no more than 15% impurity, wherein impurity intends compounds other than 3-HP. In one variation, a substantially pure preparation is provided wherein the preparation contains no more than 25% impurity, or no more than 20% impurity, or no more than 10% impurity, or no more than 5% impurity, or no more than 3% impurity, or no more than 1% impurity, or no more than 0.5% impurity.

It is understood that a 3-HP pathway passing through a β-alanine intermediate can be applied for β-alanine production (e.g., if a downstream gene converting β-alanine to malonate semialdehyde is disrupted; see FIG. 1). In this case, the recombinant yeast cell would produce β-alanine instead of 3-HP or a mixture of β-alanine and 3-HP. It is further understood that, if desired, β-alanine expressed by a recombinant yeast cell described herein can be chemically converted to 3-HP by methods known in the art, as mentioned supra.

3-HP produced using the methods disclosed herein can be chemically converted into other organic compounds. For example, 3-HP can be hydrogenated to form 1,3 propanediol, a valuable polyester monomer. Propanediol also can be created from 3-HP using polypeptides having oxidoreductase activity in vitro or in vivo. Hydrogenating an organic acid such as 3-HP can be performed using any method such as those used to hydrogenate succinic acid and/or lactic acid. For example, 3-HP can be hydrogenated using a metal catalyst.

The 3-HP produced by any of the methods described herein may be converted to acrylic acid. Acrylic acid can be produced by the chemical dehydration of 3-HP using techniques known in the art, e.g., heating in the presence of a catalyst (e.g., a solid oxide dehydration catalyst such as titania or alumina).

In one aspect is a method of producing acrylic acid or a salt thereof, comprising: (a) cultivating a recombinant yeast cell described herein (e.g., a recombinant host cell comprising an active 3-HP pathway and a heterologous polynucleotide encoding a GAPN) in a medium under suitable conditions to produce 3-HP; (b) recovering the 3-HP; (c) dehydrating the 3-HP under suitable conditions to produce acrylic acid or a salt thereof; and (d) recovering the acrylic acid or salt thereof.

Suitable assays to test for the production of 3-HP and acrylic acid for the methods of production and yeast cells described herein can be performed using methods known in the art. For example, final 3-HP product and intermediates (e.g., (β-alanine), as well as other organic compounds, can be analyzed by methods such as HPLC (High Performance Liquid Chromatography), GC-MS (Gas Chromatography Mass Spectroscopy) and LC-MS (Liquid Chromatography-Mass Spectroscopy) or other suitable analytical methods using routine procedures well known in the art. The release of 3-HP in the fermentation broth can also be tested with the culture supernatant. Byproducts and residual sugar in the fermentation medium (e.g., glucose) can be quantified by HPLC using, for example, a refractive index detector for glucose and alcohols, and a UV detector for organic acids (Lin et al., *Biotechnol. Bioeng.* 90:775-779 (2005)), or using other suitable assay and detection methods well known in the art.

The following examples are provided by way of illustration and are not intended to be limiting of the invention.

EXAMPLES

Chemicals used as buffers and substrates were commercial products of at least reagent grade.
Media and Solutions
TE was composed of 10 mM Tris Base and 1 mM EDTA, pH 8.0.
2×YT+ amp plates were composed of 16 g/L tryptone, 10 g/L yeast extract, 5 g/L NaCl, 100 mg/L ampicillin, and 15 g/L Bacto agar.
ura selection plates were composed of 6.7 g yeast nitrogen base with ammonium sulfate, 5 g casamino acids, 100 mL 0.5 M succinic acid pH 5, 20 g Noble agar, and 855 mL deionized water. Following autoclave sterilization, 40 mL sterile 50% glucose and 2 mL 10 mg/mL chloraphenicol were added and plates poured.

ura selection media was composed of 6.7 g yeast nitrogen base with ammonium sulfate, 5 g casamino acids, 100 mL 0.5 M succinic acid pH 5, and 855 mL deionized water. Following autoclave sterilization, 40 mL sterile 50% glucose and 2 mL 10 mg/mL chloraphenicol were added.

YP+10% glucose media was composed of 500 mL YP broth and 100 mL sterile 50% glucose.

YP broth was composed of 10 g/L of yeast extract, 20 g/L of peptone.

YPD plates were composed of 10 g of yeast extract, 20 g of peptone, 20 g bacto agar, and deionized water to 960 mL. Following autoclave sterilization, 40 mL sterile 50% glucose was added and plates poured.

TAE was composed of 4.84 g/L of Tris base, 1.14 mL/L of glacial acetic acid, and 2 mL/L of 0.5 M EDTA pH 8.0.

TBE was composed of 10.8 g/L of Tris base, 5.5 g/L boric acid, and 4 mL/L of 0.5 M EDTA pH 8.0.

LiOAc/TE solution was composed of 8 parts sterile water, 1 part 1 M LiOAc, and 1 part 10×TE.

10×TE (200 mL) was composed of 2.42 g Tris Base, 4 mL 0.5M EDTA, pH 8.0. 5 M HCl was used to adjust the pH to 7.5 and the solution was sterilized by autoclave.

PEG/LiOAc/TE Solution was composed of 8 parts 50% PEG3350, 1 part 1 M LiOAc, and 1 part 10×TE.

50% PEG3350 was prepared by adding 100 g PEG3350 to 150 mL water and heating and stirring until dissolved. The volume was then brought up to 200 mL with water and the sterilized by autoclave.

ScD FOA plates were composed of 275 mL 2×-ScD 2×FOA liquid media and 275 mL 2×-ScD 2×FOA plate media, melted and cooled to 65° C.

2×-ScD 2×FOA liquid media was composed of 6.66 g yeast nitrogen base without amino acids, 1.54 g ura-DO supplement (Clontech, Mountain View, Calif., USA), 20 g dextrose, 50 mg uracil, 2 mg uridine, and 2 g 5-FOA (5-fluoroorotic acid, monohydrate; Toronto Research Chemicals, North York, ON, Canada) and water to 1 L. The resulting solution was filtered to sterilize.

2×-ScD 2×FOA plate media was composed of 11 g bacto agar and 275 mL water. The resulting solution was autoclaved to sterilize.

DM2 medium was composed of ammonium sulfate (5.0 g/L), magnesium sulfate heptahydrate (0.5 g/L), potassium phosphate monobasic (3.0 g/L), trace element solution (1 mL/L) and vitamin solution (1 mL/L). After dissolving all medium components, the pH of the medium was adjusted to the desired initial pH using an appropriate base (e.g., KOH).

Trace element solution was composed of EDTA (15.0 g/L), zinc sulfate heptahydrate (4.5 g/L), manganese chloride dehydrate (1.0 g/L), Cobalt(II)chloride hexahydrate (0.3 g/L), Copper(II)sulfate pentahydrate (0.3 g/L), disodium molybdenum dehydrate (0.4 g/L), calcium chloride dehydrate (4.5 g/L), iron sulphate heptahydrate (3 g/L), boric acid (1.0 g/L), and potassium iodide (0.1 g/L).

Vitamin solution was composed of biotin (D-; 0.05 g/L), calcium pantothenate (D+; 1 g/L), nicotinic acid (5 g/L), myo-inositol (25 g/L), pyridoxine hydrochloride (1 g/L), p-aminobenzoic acid (0.2 g/L), and thiamine hydrochloride (1 g/L).

DM1 X-α-gal plates were composed of DM1 salts, 20 g/L glucose, trace element solution, vitamin solution, 2 mL/L X-α-gal (16 mg/mL), and 20 g/L agar.

DM1 salt solution was composed of 2.28 g/L urea, 3 g/L potassium phosphate monobasic, and 0.5 g/L magnesium sulfate heptahydrate.

Butterfields Phosphate Buffer was composed of 1.25 mL/L of Stock Solution (26.22 g/L Potassium Dihydrogen Phosphate and 7.78 g/L Sodium Carbonate) and 5 mL/L of a Magnesium Chloride solution (81.1 g/L $MgCl_2 \cdot 6H_2O$). The resulting solution was autoclaved to sterilize, and pH adjusted to 7.2.

CNB1 shake flask media was composed of urea (2.3 g/L), magnesium sulfate heptahydrate (0.5 g/L), potassium phosphate monobasic (3.0 g/L), trace element solution (1 mL/L) and vitamin solution (1 mL/L), glucose (120.0 g/L), 2-(N-Morpholino)ethanesulfonic acid (MES) (97.6 g/L). After dissolving all medium components, the pH of the medium was adjusted to an initial pH of 5.8 using an appropriate base (e.g, KOH).

TABLE 2

Primers sequences

| Identifier | SEQ ID NO: | Sequence (5'-3') |
|---|---|---|
| 0611247 | 163 | CGGACATGTTTTTAAAGGAAG |
| 0611554 | 164 | GCATGGTGGTGCAAGCGACG |
| 0611622 | 165 | ATGGGCTGACCTGAAAATTC |
| 0611717 | 166 | CGCTACGATACGCTACGATA |
| 0611718 | 167 | CTCCCTTCCCTGATAGAAGG |
| 0612362 | 168 | TTTGATGATAAATCTGTATTATAGTCG |
| 0612366 | 169 | GCTGAAAATATCATTCAGAGCAT |
| 0612908 | 170 | GATATGGGCGGTAGAGAAGA |
| 0612909 | 171 | GCTCCTTCAAAGGCAACACA |
| 0614233 | 172 | GATGATATAGTTGATGCTTTCCAAAG |
| 0614234 | 173 | CGTGTCTGTTCCTTAGCAAGACAC |
| 0614235 | 174 | AATCGACAATGTCGGCACCT |
| 0614308 | 175 | CGGGTCTTGCTTTTGTTT |
| 0614309 | 176 | CCCACAACTTACGGCG |
| 0614626 | 177 | AGGGTACCTTAGTACGAAGG |
| 0614627 | 178 | CTATTCTTACGATGAAGGCG |
| 0614891 | 179 | CAAACCCAGTACACAATATTGC |
| 0614892 | 180 | CCAGTGATGACATTTGATGGTTATC |
| 0615118 | 181 | CTTCCTTTAAAAACATGTCCG |
| 0615158 | 182 | TGAAGAAAACAGCAAACTTTTTATG |
| 0615910 | 183 | GGGAATTACAGAAAAACTCGG |
| 0615911 | 184 | CGCATACACAGATCATCAAGG |

Example 1

Procedure for Transformation of DNA into the Yeast Genome

DNA transformation into the yeast host genome to generate the recombinant yeast strains described in the following examples was conducted based on the specific procedure below.

Three mL of YP+10% glucose media was added to a 14 mL Falcon tube and the desired strain was inoculated into this media using a sterile loop. The culture was grown with shaking at 250 rpm overnight (~16 hr) at 37° C. 0.5 mL of the overnight culture was added to a 125 mL baffled flask containing 25 mL of liquid YP+10% glucose media. The flask was grown with shaking at 250 rpm at 37° C. Small aliquots of the culture were withdrawn at approximately hourly intervals and the $OD_{600}$ was measured. The culture was grown until the $OD_{600}$ was 0.6-1.0.

The cells were harvested by centrifugation at 2279×g at room temperature, the pellet was resuspended in 25 mL sterile water, then centrifuged at 2279×g at room temperature. The pellet was resuspended in 1 mL sterile water, and the resuspended cells were transferred to a 1.5 mL tube and then pelleted at 16,100×g. The cells were resuspended in 1 mL LiOAc/TE solution and then pelleted at 16,100×g. The cell pellet was then resuspended in 250 µL LiOAc/TE solution.

The following components were added to a 1.5 mL tube: 100 µL of the above cells, 10 µL freshly boiled then iced salmon sperm DNA (Agilent Technologies, Santa Clara, Calif., USA), and 10 µL of the desired, linearized transforming DNA. A control reaction with water instead of DNA was also prepared. To each transformation reaction, 600 µL of PEG/LiOAc/TE Solution was added, followed by 40 µL DMSO and the reactions were inverted several times to mix. The transformation reactions were incubated in a 42° C. water bath for 15 minutes, and cells were pelleted at 5,400×g for 1 min. Cells were resuspended in water, split in two, and each half of the transformation reaction was plated to a ura selection media plate. Plates were placed at 37° C. Colonies were visible after 2 days of growth.

Example 2

Construction of Yeast Strains Comprising an Active 3-HP Pathway

This example describes the construction of yeast strains having an active 3-HP pathway, wherein the strains express four copies of polynucleotides encoding the B. licheniformis ADC (SEQ ID NO: 139) at the adh1202 locus, one copy of a polynucleotide encoding the I. orientalis PYC (SEQ ID NO: 2) at the pdc locus, three copies of polynucleotides encoding the B. licheniformis ADC (SEQ ID NO: 139) together with up-regulation of the endogenous polynucleotide encoding the I. orientalis PYC (SEQ ID NO: 2) at the pyc locus, four copies of polynucleotides encoding the B. licheniformis ADC (SEQ ID NO: 139) at the adh9091 locus, and a disruption of the endogenous glycerol 3-phosphate dehydrogenase GPD gene.

A ura-derivative of I. orientalis CNB1 yeast strain McTs253 (US2012/0135481), expressing aspartate 1-decarboxylase (ADC) from four polynucleotide sequences at the adh1202 locus and pyruvate carboxylase (PYC) at the pdc locus, was isolated as described previously (US2012/0135481). Several FOA resistant colonies of McTs253 were screened for lack of growth on ura minus selection plates and by PCR for the desired loop-out event. Using primers 0614233 and 0611554, appearance of a 4.6 kbp band by gel electrophoresis indicated the presence of only the ura3 scar site (a single URA3 promoter left behind after homologous recombination between the two URA3 promoters in the parent strain) as desired, while a band of approximately 5.9 kbp indicated the presence of the intact URA3 promoter-URA3 ORF-URA3 terminator-URA3 promoter cassette, indicating the desired recombination event did not occur. PCR reactions using Phire Plant Direct PCR Kit (Finnzymes) were carried out according to the manufacturer's instructions. One FOA resistant colony from parent strain McTs253 that had the desired loop-out event was designated McTs258.

Figure 11:
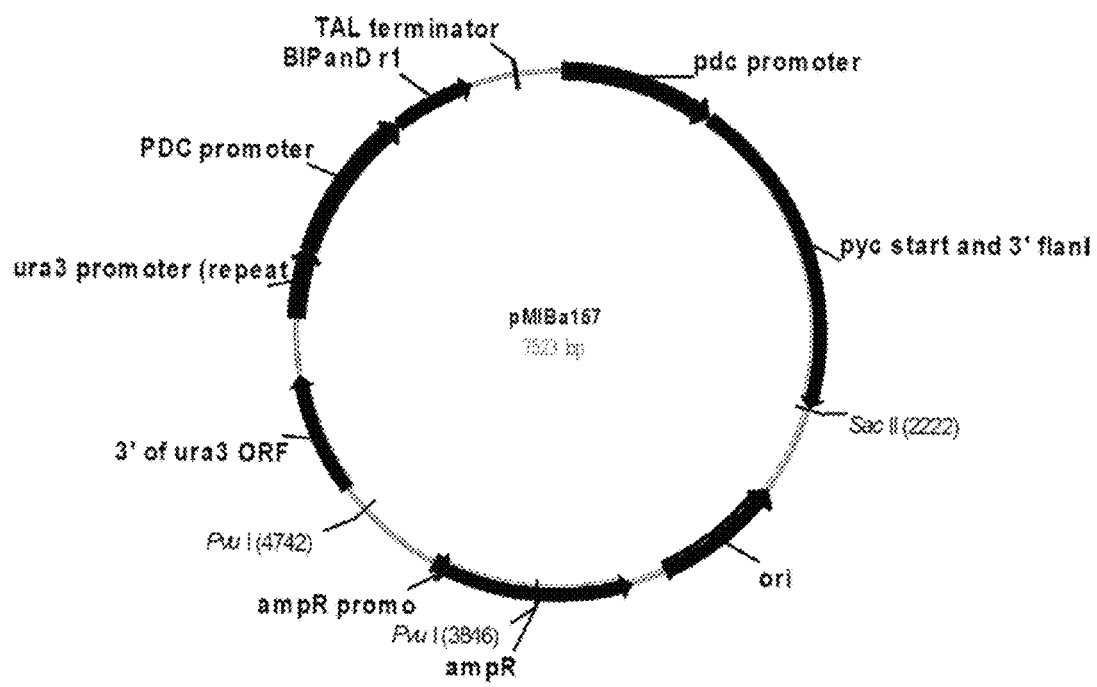
FIG. 11 shows a plasmid map for pMIBa157.
Figure 12:
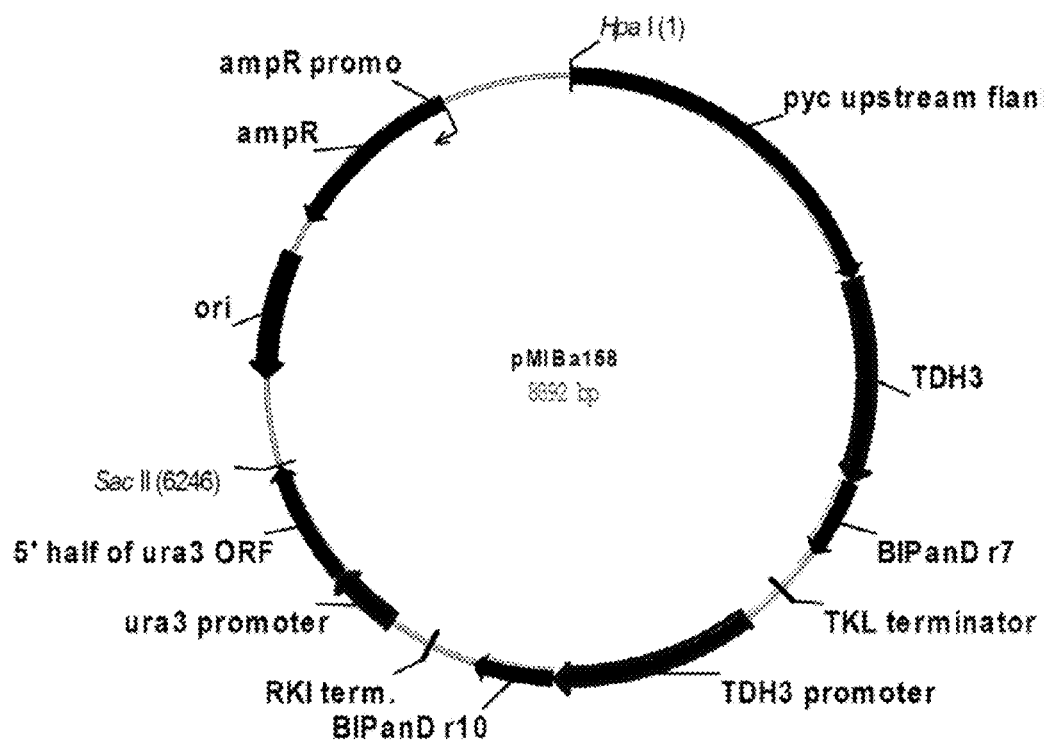
FIG. 12 shows a plasmid map for pMIBa158.

Strain McTs258 (supra) was transformed with PvuI/SacII-digested pMIBa157 (FIG. 11), and HpaI/SacII-digested pMIBa158 (FIG. 12), to integrate three copies of polynucleotides encoding the B. licheniformis ADC at the pyc locus and replace the native PYC promoter with the PDC promoter (see US2012/0135481 for similar experimental procedures). Correct loci targeting and transformation was verified by PCR using a Phire Plant Direct PCR Kit (Finnzymes) with primers 0614308 and 0615118 (designed to yield an approximately 4.4 kbp band by gel electrophoresis) and 0611247 and 0614235 (designed to yield an approximately 4.7 kbp band by gel electrophoresis). A strain which gave the expected bands for proper integration of the cassette at the pyc locus was designated MIBa400.

A ura-derivative of MIBa400 (supra) was isolated as described in US2012/0135481. Several FOA resistant colonies of MIBa400 were screened by PCR for the desired loop-out event with primers 0612362 and 0611717. The appearance of an 0.70 kbp band by gel electrophoresis indicates the presence of only the ura3 scar site (a single URA3 promoter left behind after homologous recombination between the two URA3 promoters in the parent strain) as desired, while a band of approximately 2.1 kbp indicates the presence of the intact URA3 promoter-URA3 ORF-URA3 terminator-URA3 promoter cassette, indicating the desired recombination event did not occur. One FOA resistant colony from parent strain MIBa400 that had the desired loop-out event was designated MIBa404.

Figure 13:
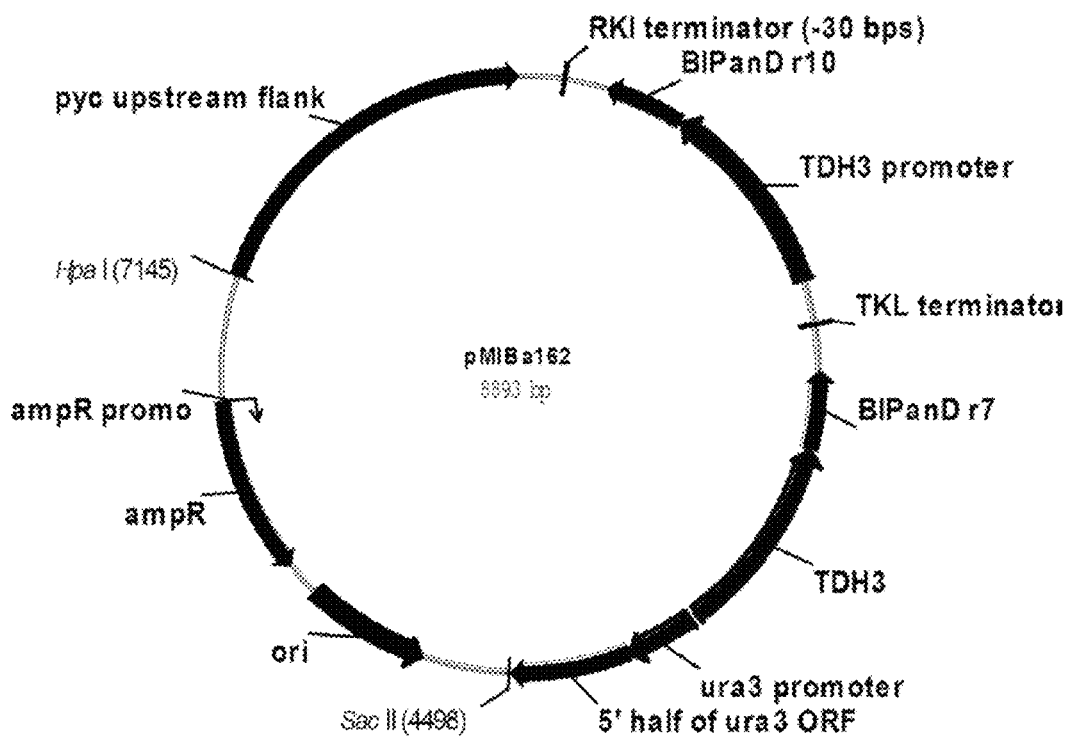
FIG. 13 shows a plasmid map for pMIBa162.

To construct a corresponding homozygous strain, MIBa404 (supra) was transformed with PvuI/SacII-digested pMIBa157 (supra), and HpaI/SacII-digested pMIBa162 (FIG. 13), and correct loci targeting and transformation was verified by PCR using Phire Plant Direct PCR Kit (Finnzymes). To confirm loss of the both wild-type pyc loci, primers 0614309 and 0611622 were designed such that an intact pyc locus would yield a band of approximately 0.45 kbp by gel electrophoresis, while insertion of the expression cassette would yield a 6.4 kbp product. For those strains that no longer had the wild-type locus primer set 0614234 and 0612362 was used to confirm the presence of the first integration, and primer set 0614234 and 0612366 was used to confirm the presence of the second integration. These primer sets were designed to yield products of 1.98 and 1.88 kbp respectively for a strain homozygous for three copies of nucleotides encoding the B. licheniformis ADC with the PDC promoter replacing the I. orientalis PYC promoter at the pyc locus. One strain which gave the expected bands as determined by gel electrophoresis for a homozygote was designated MIBa408.

A ura-derivative of MIBa408 (supra) was isolated as described in US2012/0135481. Several FOA resistant colonies of MIBa408 were screened by PCR for the desired loop-out event with primers 0612366 and 0611717. The appearance of a 0.60 kbp band by gel electrophoresis indicates the presence of only the ura3 scar site (a single URA3 promoter left behind after homologous recombination between the two URA3 promoters in the parent strain) as desired, while a band of approximately 2.0 kbp indicates the presence of the intact URA3 promoter-URA3 ORF-URA3 terminator-URA3 promoter cassette, indicating the desired recombination event did not occur. One FOA resistant colony from parent strain MIBa408 that had the desired loop-out event was designated MIBa413.

Figure 14:
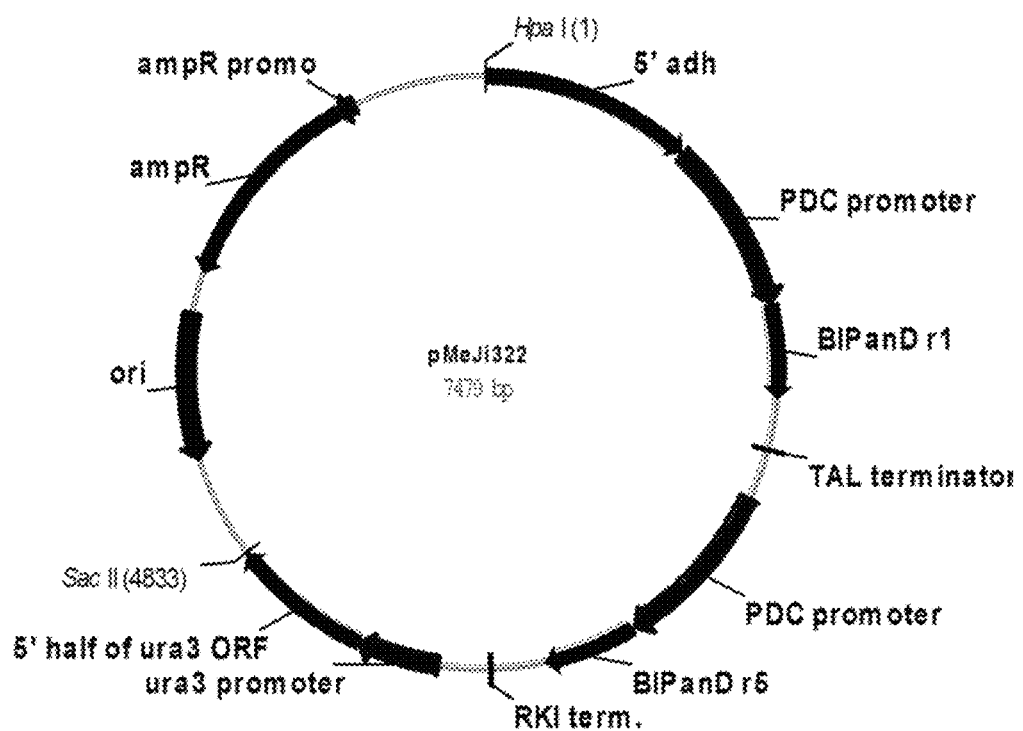
FIG. 14 shows a plasmid map for pMeJi322.
Figure 15:
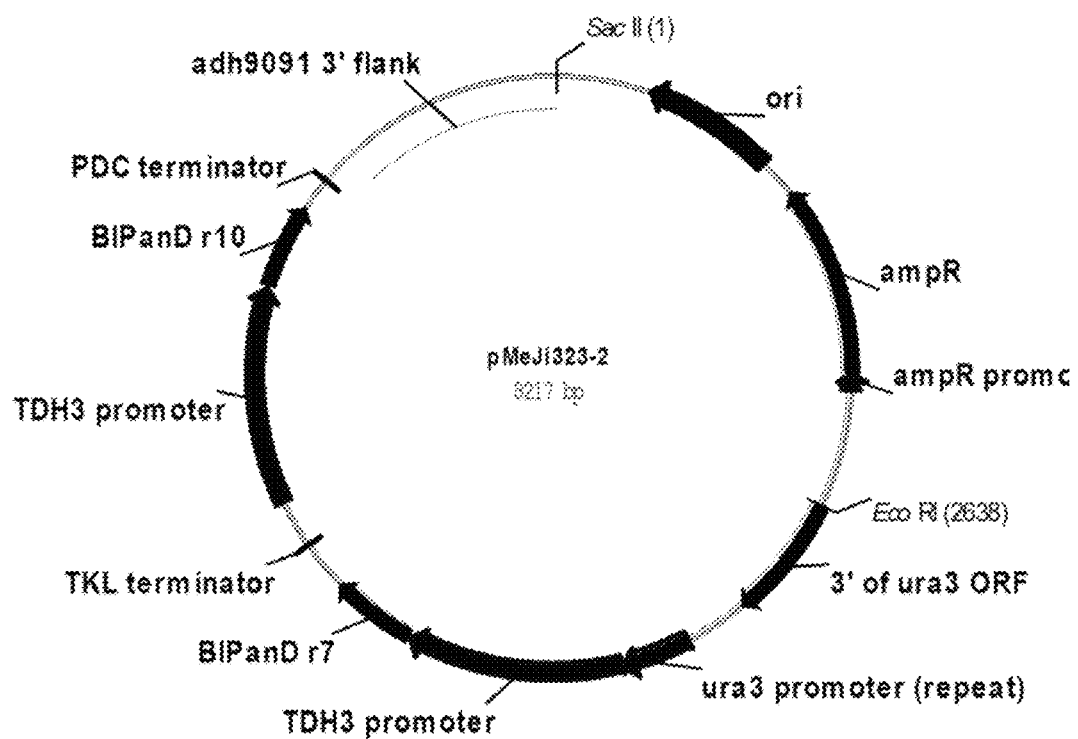
FIG. 15 shows a plasmid map for pMeJi323-3.

Strain MIBa413 (supra) was transformed with HpaI/SacII-digested pMeJi322 (FIG. 14), and EcoRI/SacII-digested pMeJi323-3 (FIG. 15), to integrate four copies of polynucleotides encoding the *B. licheniformis* ADC at the adh9091 locus (see US2012/0135481 for similar experimental procedures). Correct loci targeting and transformation was verified by PCR using a Phire Plant Direct PCR Kit (Finnzymes) with primers 0615118 and 0614627 (designed to yield an approximately 4.2 kbp band by gel electrophoresis) and 0611247 and 0614626 (designed to yield an approximately 4.6 kbp band by gel electrophoresis). One strain which gave the expected bands was designated MIBa418.

A ura-derivative of MIBa418 (supra) was prepared as described in US2012/0135481. Several FOA resistant colonies of MIBa418 were screened by PCR for the desired loop-out event with primers 0612366 and 0614627. The presence of a 4.4 kbp band by gel electrophoresis indicates the presence of only the ura3 scar site (a single URA3 promoter left behind after homologous recombination between the two URA3 promoters in the parent strain) as desired, while a band of approximately 5.8 kbp indicates the presence of the intact URA3 promoter-URA3 ORF-URA3 terminator-URA3 promoter cassette, indicating the desired recombination event did not occur. One FOA resistant colony from parent strain MIBa418 that had the desired loop-out event was designated MIBa422.

Figure 16:
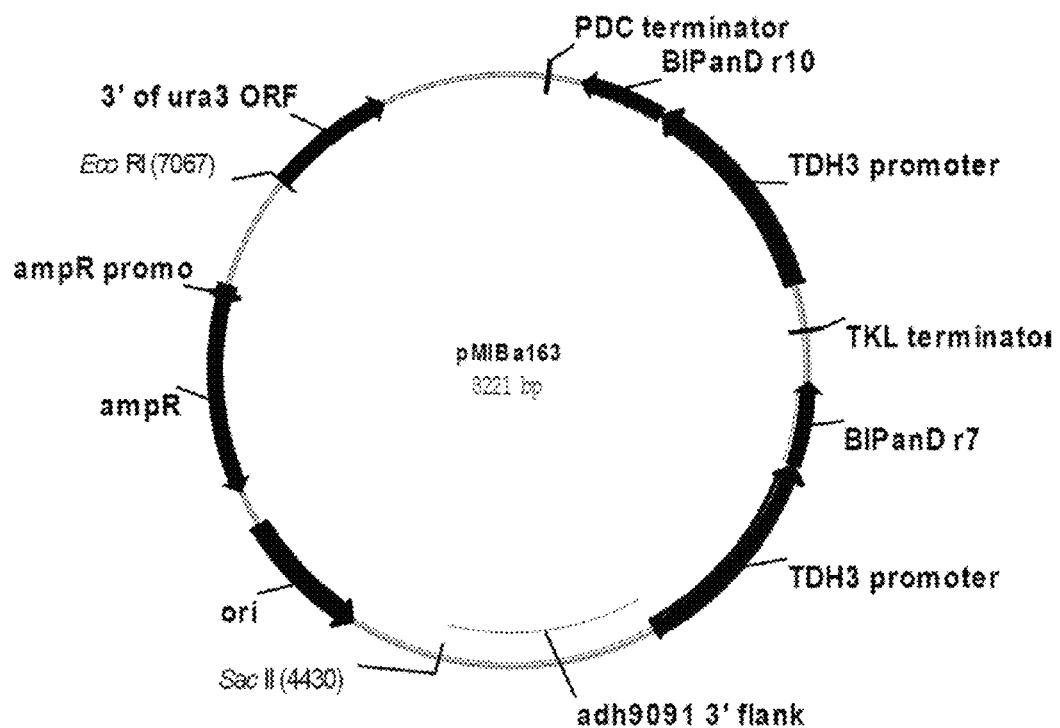
FIG. 16 shows a plasmid map for pMIBa163.

To construct a corresponding homozygous strain, MIBa422 (supra) was transformed with the HpaI/SacII-digested pMeJi322 (FIG. 14) and EcoRI/SacII-digested pMIBa163 (FIG. 16), and correct loci targeting and transformation was verified by PCR using a Phire Plant Direct PCR Kit (Finnzymes). To confirm loss of the both wild-type adh9091 loci, primers 0615158 and 0614626 were designed such that an intact adh9091 locus would yield a band of approximately 1.3 kbp by gel electrophoresis, but insertion of the expression cassette would result in no amplification fragment. For those strains that no longer had the wild-type locus, primer set 0611718 and 0614626 was used to confirm the presence of the first integration, and primer set 0612366 and 0614626 was used to confirm the presence of the second integration. Each primer set was designed to yield an approximately 1.2 kbp product for a strain homozygous for four copies of nucleotides encoding the *B. licheniformis* ADC at the adh9091 locus. One strain which gave the expected bands for a homozygote was designated MIBa425.

A ura-derivative of strain MIBa425 (supra) was isolated as described previously. Several FOA resistant colonies of MIBa425 were screened for lack of growth on ura minus selection plates by PCR for the presence of the first and second integration cassettes at adh9091. Primer set 0611718 and 0614626 was used to confirm the presence of the first integration, and primer set 0612366 and 0614626 was used to confirm the presence of the second integration. Each primer set was designed to yield an approximately 1.2 kbp product for a ura minus strain homozygous for four copies of nucleotides encoding the *B. licheniformis* ADC at the adh9091 locus. One strain which gave the expected bands for a homozygote was designated MIBa429.

Strain MIBa429 (supra) was transformed with ApaI/SphI/SacI-digested pHJJ56 (US2012/0135481) to disrupt the GPD gene. Correct loci targeting and transformation was verified by PCR using a Phire Plant Direct PCR Kit (Finnzymes) with primers 0614891 and 0612908 (designed to yield an approximately 1.9 kbp band by gel electrophoresis) and primers 0612909 and 0614892 (designed to yield an approximately 2.0 kbp band by gel electrophoresis) when the GPD gene is disrupted. One strain which gave the expected bands was designated McTs403.

A ura-derivative of McTs403 (supra) was isolated as described in US2012/0135481. Several FOA resistant colonies of McTs403 were screened by PCR for the desired loop-out event with primers 0614891 and 0611718. The presence of an 1.4 kbp band by gel electrophoresis indicates the presence of only the ura3 scar site (a single URA3 promoter left behind after homologous recombination between the two URA3 promoters in the parent strain) as desired, while a band of approximately 2.9 kbp indicates the presence of the intact URA3 promoter-URA3 ORF-URA3 terminator-URA3 promoter cassette, indicating the desired recombination event did not occur. One FOA resistant colony from parent strain MIBa418 that had the desired loop-out event was designated MeJi457.

To construct a corresponding homozygous strain, MeJi257 (supra) was transformed with the digested pHJJ57 (US2012/0135481) and correct loci targeting and transformation was verified by PCR using a Phire Plant Direct PCR Kit (Finnzymes). Primer set 0614891 and 0611718 (designed to yield an approximately 1.4 kbp band by gel electrophoresis) was used to confirm the presence of the GPD deletion cassette at the first locus, and primer set 0612908 and 0614892 (designed to yield an approximately 2 kbp band by gel electrophoresis) were used to confirm the presence of the GPD deletion cassette at the second locus. One strain which gave the expected bands was designated MeJi461.

A ura-derivative of MeJi461 (supra) was isolated as described in US2012/0135481. Several FOA resistant colonies of MeJi461 were screened by PCR for the desired loop-out event with primers 0611718 and 0614892. The presence of an 1.6 kbp band by gel electrophoresis indicates the presence of only the ura3 scar site (a single URA3 promoter left behind after homologous recombination between the two URA3 promoters in the parent strain) as desired, while a band of approximately 2.9 kbp indicates the presence of the intact URA3 promoter-URA3 ORF-URA3 terminator-URA3 promoter cassette, indicating the desired recombination event did not occur. One FOA resistant colony from parent strain MeJi461 that had the desired loop-out event was designated MeJi465.

Example 3

Construction of Insertion Vectors for Expressing a Heterologous Non-Phosphorylating NADP-Dependent Glyceraldehyde-3-Phosphate Dehydrogenase (GAPN) at the Yeast Scw11 Locus pMBin227 (*Streptococcus mutans* GAPN)

The plasmid pMBin227 was designed to allow integration of the *Streptococcus mutans* GAPN coding sequence at the *I. orientalis* scw11 locus under the control of the PDC promoter and terminator using URA3 as a selectable marker, and was constructed as described below.

A codon-optimized version of the GAPN coding sequence from *Streptococcus mutans* (SEQ ID NO: 153, encoding the GAPN of SEQ ID NO: 154) was synthesized by GenScript (Piscataway, N.J.) and was obtained in vector pUC57 with an added TAAA kozak sequence and flanking 5' XbaI and 3' PacI sites. The *S. mutans* GAPN coding sequence was removed from the pUC57 plasmid by digestion with XbaI and PacI and separated on a 1.0% agarose gel in TAE buffer where the approximately 1.4 kbp fragment (containing the *S. mutans* GAPN coding sequence) was excised from the gel and purified using a QIAQUICK® Gel Extraction Kit (Qiagen) according to the manufacturer's instructions.

Figure 3:
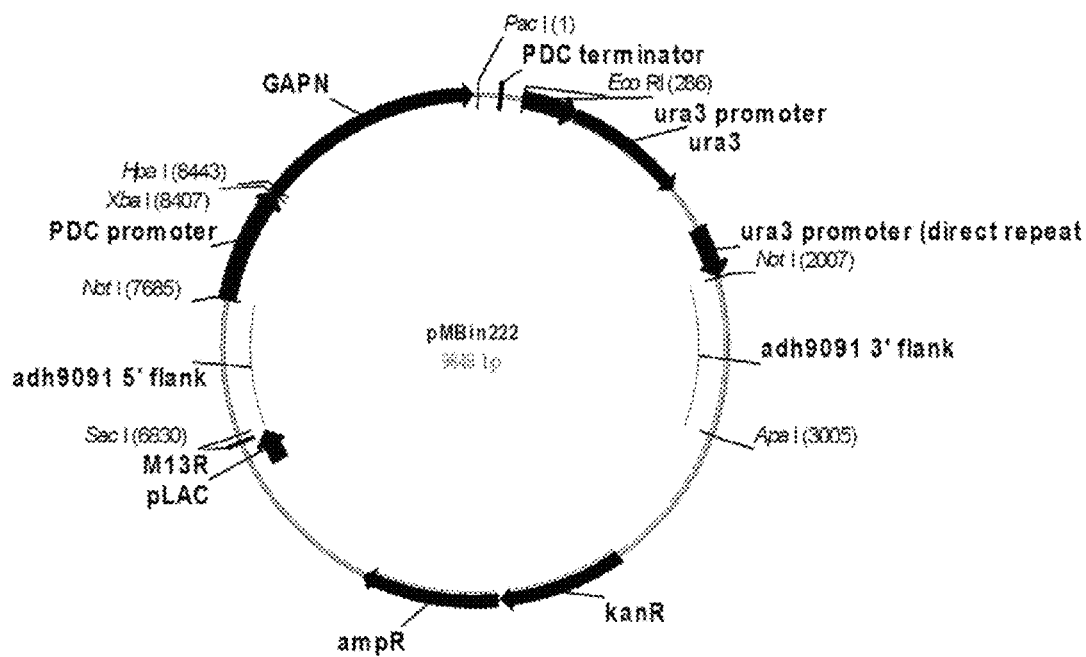
FIG. 3 shows a plasmid map for pMBin222.

The plasmid pMBin204 (US2012/0135481) was digested with XbaI and PacI, and then purified by agarose gel electrophoresis in TAE buffer. A band of approximately 8.4 kbp was excised from the gel and purified using a QIAQUICK® Gel Extraction Kit (Qiagen) according to the manufacturer's instructions. The 1.4 kbp XbaI/PacI fragment containing the *S. mutans* GAPN coding sequence (supra) was ligated into the 8.4 kbp pMBin204 (supra) linearized vector using T4 ligase (New England Biolabs) in a total reaction volume of 10 μL composed of 1 μL of the 8.4 kbp vector, 4 μL of the 1.4 kbp insert, 1 μL 10× ligation buffer with 10 mM ATP (New England Biolabs), 3 μl gdH₂O and 1 μL T4 ligase (New England Biolabs). The reaction was incubated for 18 hours at 22° C. and a 4 μL aliquot of the reaction was transformed into One Shot TOP10 cells (Invitrogen) according to manufacturer's instructions. After a recovery period, two 100 μL aliquots from the transformation reaction were plated onto 150 mm 2×YT plates supplemented with 100 μg of ampicillin per ml. The plates were incubated overnight at 37° C. Putative recombinant clones were selected from the selection plates and plasmid DNA was prepared from each one using a BIOROBOT® 9600 (Qiagen). Clones were analyzed by restriction digest and a plasmid with the correct restriction digest pattern was designated pMBin222 (FIG. 3). Plasmid pMBin222 contains the *S. mutans* GAPN coding sequence under control of the PDC promoter and terminator, with the URA3 selectable marker flanked by regions of homology to the adh9091 locus.

Figure 4:
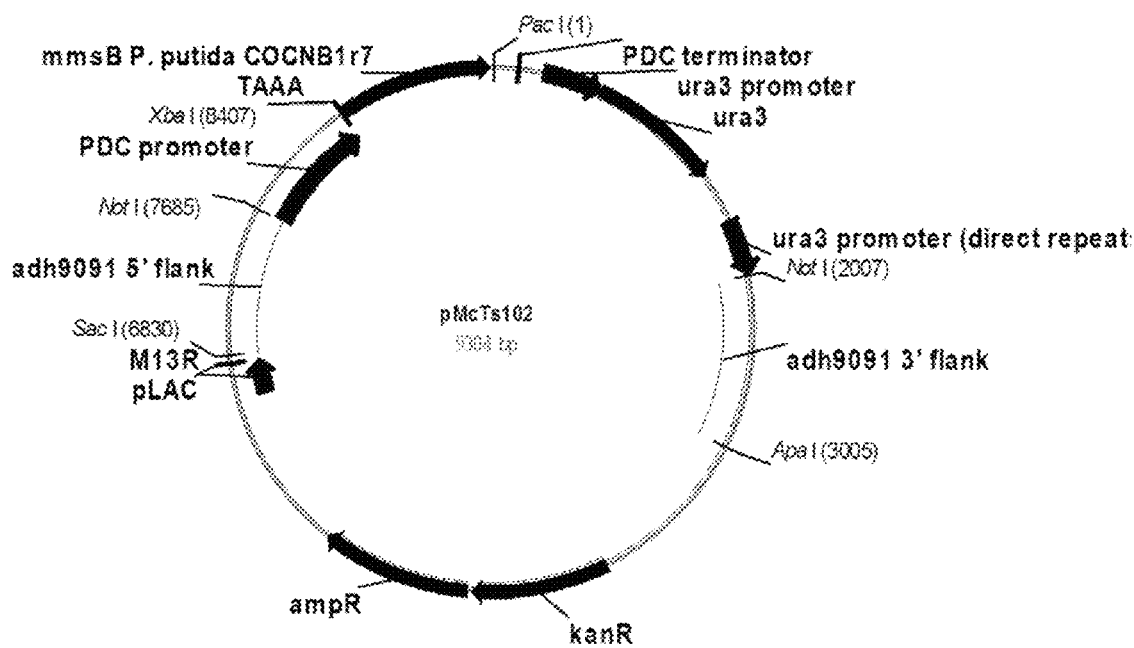
FIG. 4 shows a plasmid map for pMcTs102.

The plasmid pMcTs128 was created to integrate the *P. putida* mmsB coding sequence at the scw11 locus under the control of the PDC promoter and terminator using URA3 as a selectable marker. The coding sequence for the *P. putida* mmsB 3-HPDH (encoding the 3-HPDH of SEQ ID NO: 31) was codon-optimized for *I. orientalis*, flanked by 5' XbaI site and 3' PacI restriction sites, and provided by GeneArt (Life Technologies Corporation, Carlsbad, Calif.) in a plasmid, which was then digested with XbaI and PacI, and the resulting 898 bp fragment was cloned into the 8.4 kbp fragment of pMBin204 (US2012/0135481) also digested with XbaI and PacI as described supra. Several recombinant clones were screened by restriction digest and sequenced. One clone with the correct sequence was designated pMcTs102 (FIG. 4).

Figure 5:
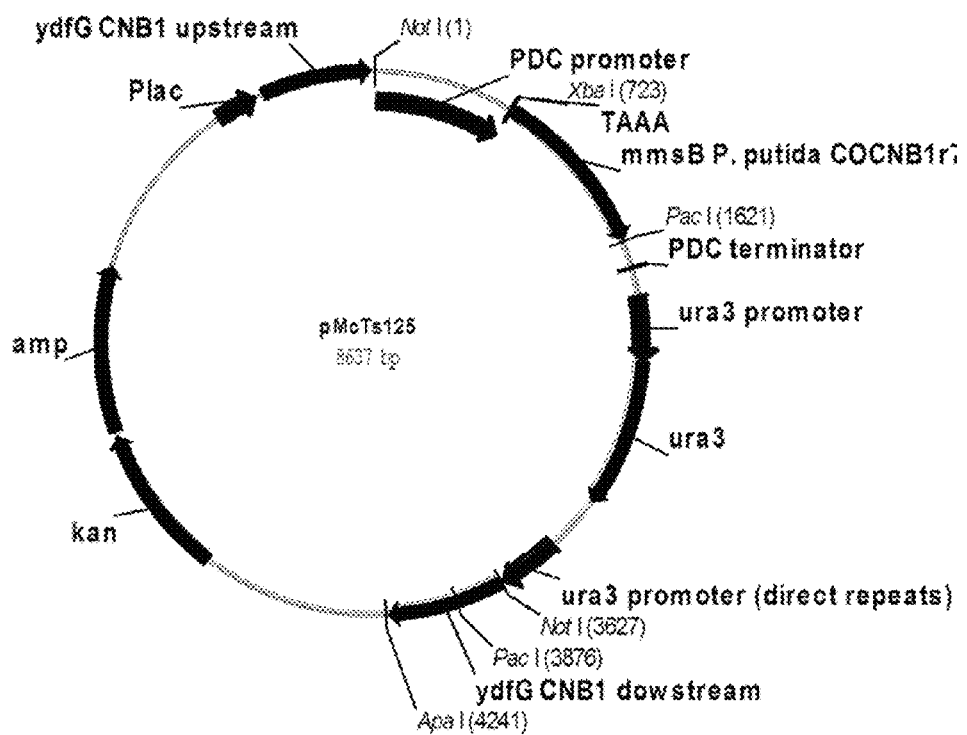
FIG. 5 shows a plasmid map for pMcTs125.
Figure 6:
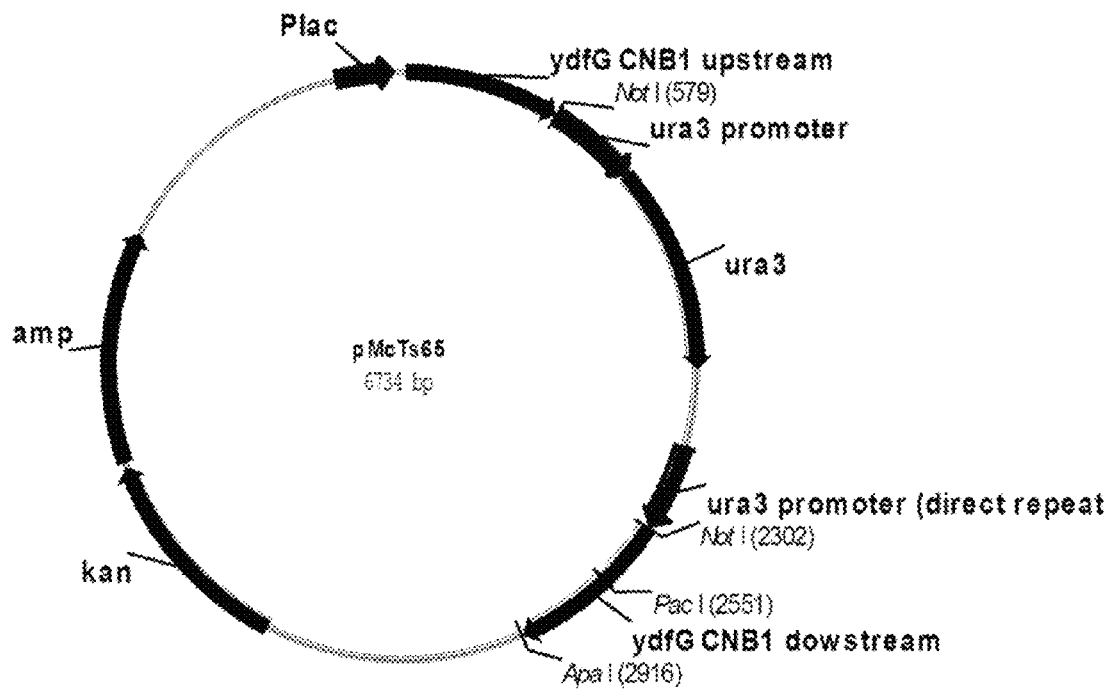
FIG. 6 shows a plasmid map for pMcTs65.
Figure 7:
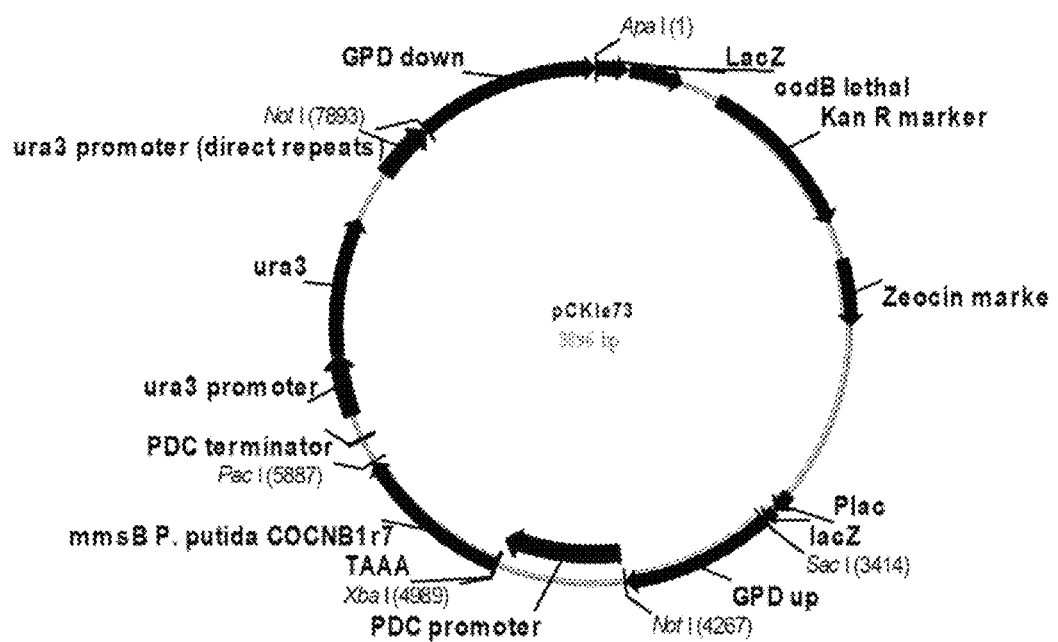
FIG. 7 shows a plasmid map for pCKIe73.

The plasmid pMcTs102 (supra) was digested with NotI and a 3.6 kbp fragment containing the PDC promoter, mmsB 3-HPDH coding sequence, PDC terminator and URA3 selectable marker was ligated into the NotI sits of pMcTs65 (FIG. 6; see also US2012/0135481) to create pMcTs125 (FIG. 5). The plasmid pMcTs125 was digested with NotI and the 3.6 kbp fragment containing the PDC promoter, mmsB, PDC terminator and URA3 selectable marker was ligated into the NotI sites of pACN62 (US2012/0135481) to create pCKIe73 (FIG. 7).

Figure 8:
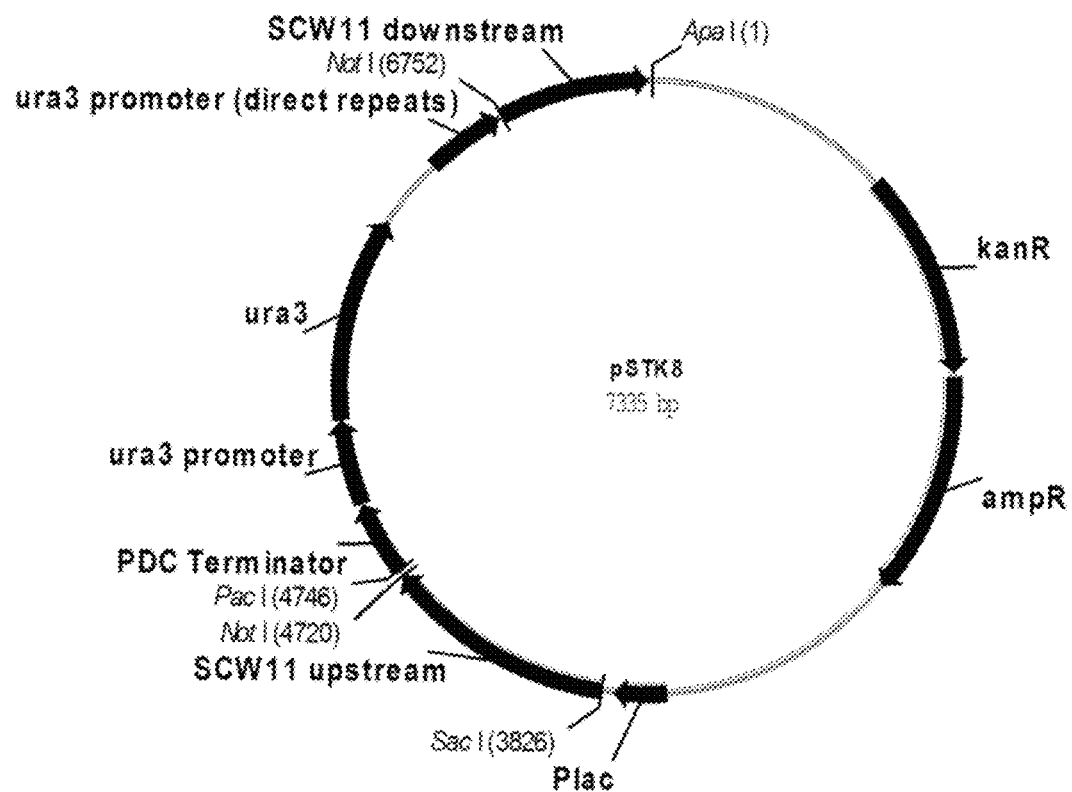
FIG. 8 shows a plasmid map for pSTK8.
Figure 9:
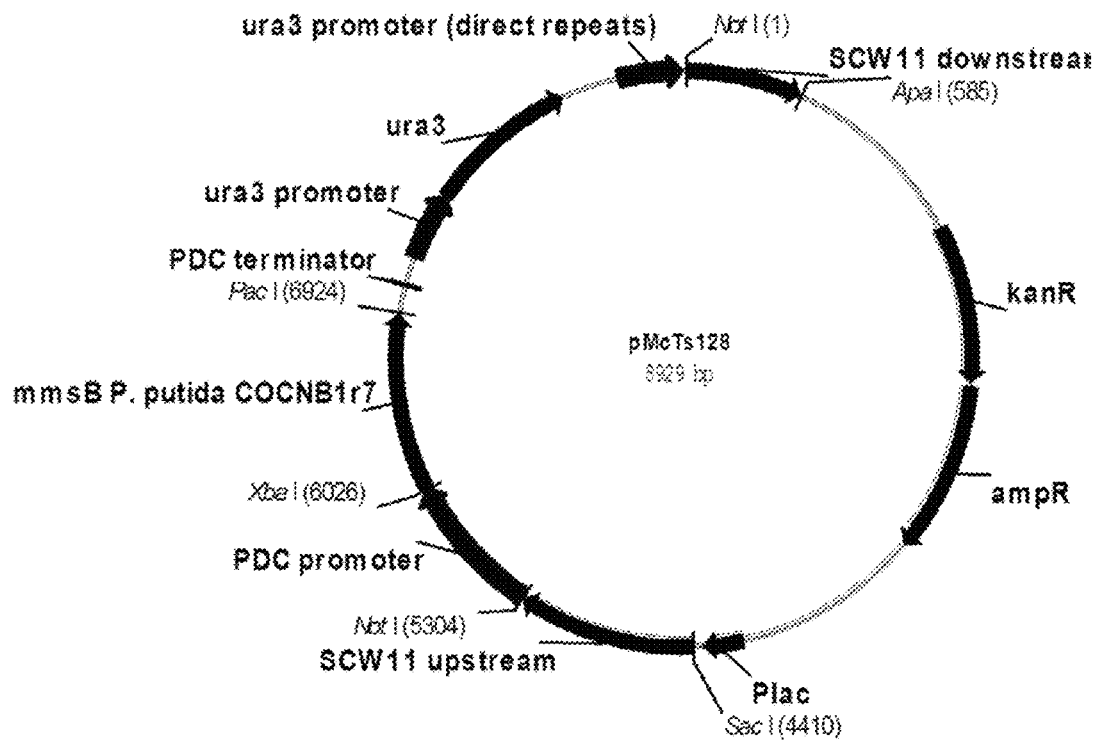
FIG. 9 shows a plasmid map for pMcTs128.

Plasmid pSTK8 (FIG. 8) contains homology to allow gene integration at the scw11 locus. Plasmid pSTK8 was digested with NotI to remove the URA3 selectable marker and PDC terminator present inside of the scw11 homology sequences. The plasmid pCKIe73 (supra) was digested with NotI and the 3.6 kbp fragment containing the PDC promoter, mmsB, PDC terminator and URA3 selectable marker was ligated into the NotI sites of pSTK8 (supra), to create pMcTs128 (FIG. 9).

The plasmid pMcTs128 (supra) was digested with XbaI and PacI to remove the mmsB gene and the plasmid was separated by 1% agarose gel electrophoresis in TAE buffer. An approximately 8 kbp linearized fragment was extracted from the agarose using a QIAQUICK® Gel Extraction Kit (Qiagen) according to the manufacturer's instructions.

Figure 10:
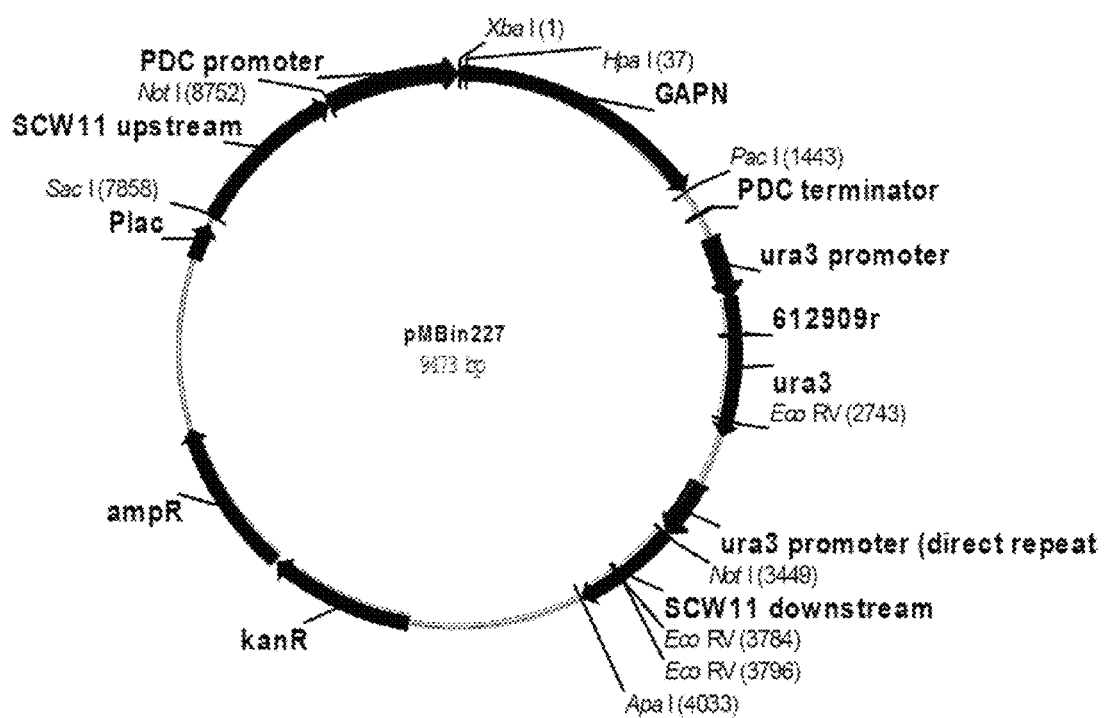
FIG. 10 shows a plasmid map for pMBin227.

The *S. mutans* GAPN gene was removed from the pMBin222 plasmid (supra) by digestion with XbaI and PacI and separated on a 1.0% agarose gel in TAE buffer where the approximately 1.4 kbp fragment (containing the *S. mutans* GAPN gene) was excised from the gel and purified using a QIAQUICK® Gel Extraction Kit (Qiagen) according to the manufacturer's instructions. The 1.4 kbp XbaI/PacI-digested fragment containing the *S. mutans* GAPN gene was ligated into XbaI and PacI sites of the 8 kbp pMcTs128 (supra) linearized vector using T4 ligase (New England Biolabs) in a total reaction volume of 10 μL composed of 2 μL of the 8 kbp vector, 6 μL of the 1.4 kbp insert, 1 μL 10× ligation buffer with 10 mM ATP (New England Biolabs), and 1 μL T4 ligase (New England Biolabs). The reaction was incubated for 18 hours at 16° C. and a 4 μL aliquot of the reaction was transformed into One Shot TOP10 cells (Invitrogen) according to manufacturer's instructions. The reaction was incubated for 18 hours at 22° C. and a 4 μL aliquot of the reaction was transformed into One Shot TOP10 cells (Invitrogen) according to manufacturer's instructions. After a recovery period, two 100 μL aliquots from the transformation reaction were plated onto 150 mm 2×YT plates supplemented with 50 μg of kanamycin per ml. The plates were incubated overnight at 37° C. Putative recombinant clones were selected from the selection plates and plasmid DNA was prepared from each one using a BIOROBOT® 9600 (Qiagen). Clones were analyzed by restriction digest and a plasmid with the correct restriction digest pattern was designated pMBin227 (FIG. 10).

Plasmid pMBin227 contains the *S. mutans* GAPN coding sequence of SEQ ID NO: 153 (encoding the GAPN of SEQ ID NO: 154) under control of the PDC promoter and terminator, with the URA3 selectable marker flanked by regions of homology to the scw11 locus.

pMBin240 (*Lactobacillus delbrueckii* GAPN) & pMBin241 (*Zea mays* GAPN)

The plasmids pMBin240 and pMBin241 were designed to allow integration of the GAPN gene from either *Lactobacillus delbrueckii* or *Zea mays* at the *I. orientalis* scw11 locus under the control of the PDC promoter and terminator using URA3 as a selectable marker, and were constructed as described below.

Codon-optimized versions of the GAPN coding sequence from *Lactobacillus delbrueckii* (SEQ ID NO: 193, encoding the GAPN of SEQ ID NO: 194) and *Zea mays* (SEQ ID NO: 191, encoding the GAPN of SEQ ID NO: 192) were synthesized by GeneArt (Life Technologies Corporation). Each was obtained in vector pMK-RQ with an added TAAA kozak sequence and flanking 5' XbaI and 3' PacI sites. The *L. delbrueckii* and *Z. mays* GAPN coding sequences were removed from the pMK-RQ plasmid by digestion with XbaI and PacI and separated on a 1.0% agarose gel in TBE buffer where the approximately 1.5 kbp fragments (containing the *L. delbrueckii* or *Z. mays* GAPN coding sequences) were excised from the gel and purified using a QIAQUICK® Gel Extraction Kit (Qiagen) according to the manufacturer's instructions.

Figure 19:
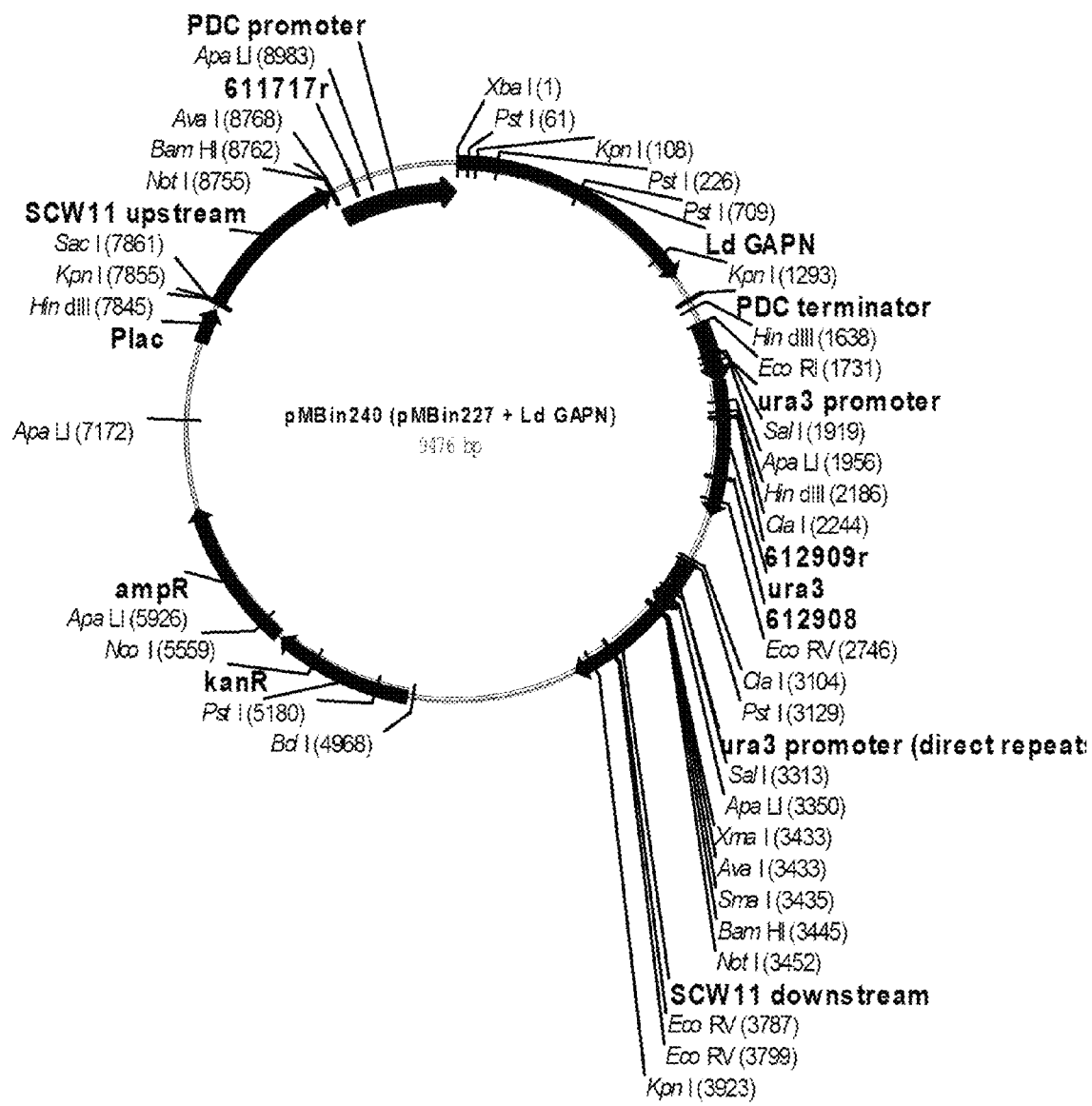
FIG. 19 shows a plasmid map for pMBin240.
Figure 20:
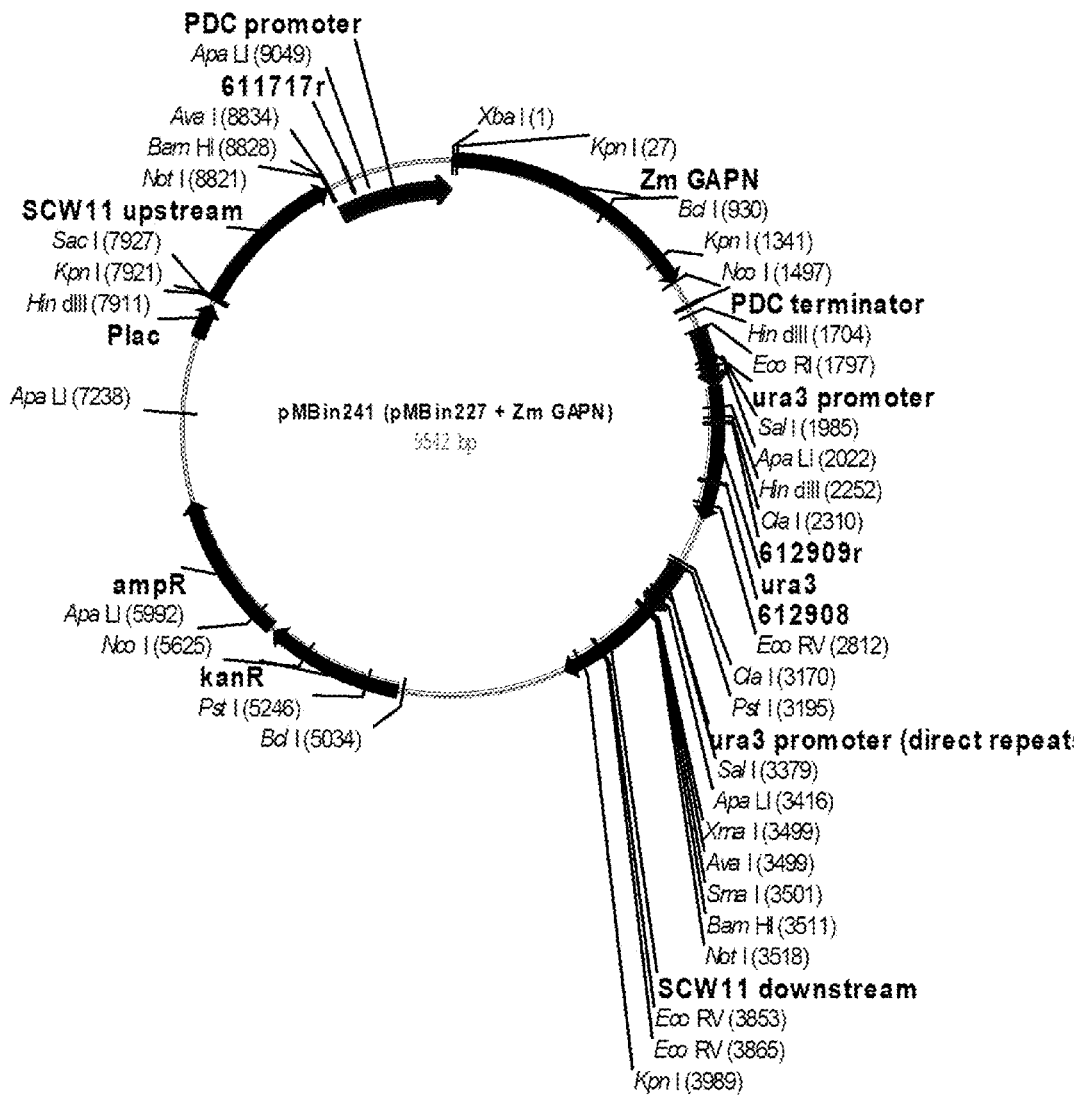
FIG. 20 shows a plasmid map for pMBin241.

The plasmid pMBin227 (supra) was digested with XbaI and PacI and then purified by agarose gel electrophoresis in TBE buffer. A band of approximately 8.0 kbp was excised from the gel and purified using a QIAQUICK® Gel Extraction Kit (Qiagen) according to the manufacturer's instructions. The 1.5 kbp XbaI/PacI fragment containing the *L. delbrueckii* or *Z. mays* GAPN coding sequence (supra) was ligated into the 8.0 kbp pMBin227 (supra) linearized vector using T4 ligase (New England Biolabs) in a total reaction volume of 10 µL composed of 1 µL of the 8.0 kbp vector, 4 µL of the 1.5 kbp insert, 1 µL 10× ligation buffer with 10 mM ATP (New England Biolabs), 3 µl gdH$_2$O and 1 µL T4 ligase (New England Biolabs). The reaction was incubated for 18 hours at 22° C. and a 4 µL aliquot of the reaction was transformed into One Shot TOP10 cells (Invitrogen) according to manufacturer's instructions. After a recovery period, two 100 µL aliquots from the transformation reaction were plated onto 150 mm 2×YT plates supplemented with 100 µg of ampicillin per ml. The plates were incubated overnight at 37° C. Putative recombinant clones were selected from the selection plates and plasmid DNA was prepared from each one using a BIOROBOT® 9600 (Qiagen). Clones were analyzed by restriction digest and plasmids with the correct restriction digest pattern were designated pMBin240 (FIG. 19) and pMBin241 (FIG. 20).

Plasmid pMBin240 contains the *L. delbrueckii* GAPN coding sequence of SEQ ID NO: 193 (encoding the GAPN of SEQ ID NO: 194) under control of the PDC promoter and terminator, with the URA3 selectable marker flanked by regions of homology to the scw11 locus. Plasmid pMBin241 contains the *Z. mays* GAPN coding sequence of SEQ ID NO: 191 (encoding the GAPN of SEQ ID NO: 192) under control of the PDC promoter and terminator, with the URA3 selectable marker flanked by regions of homology to the scw11 locus.

Example 4

Construction of Yeast Strains Comprising an Active 3-HP Pathway and Expressing a Heterologous Non-Phosphorylating NADP-Dependent Glyceraldehyde-3-Phosphate Dehydrogenase (GAPN) at the Yeast Scw11 Locus MBin558/559/560 (*S. Mutans* GAPN)

Approximately 18 µg of pMBin227 from Example 3 was digested with ApaI and SacI, and then separated on a 1% agarose gel using TAE buffer. An approximately 5.6 kbp fragment was excised from the gel and purified using a QIAQUICK® Gel Extraction Kit (Qiagen) according to the manufacturer's instructions. Approximately 900 ng of the pMBin227 fragment was transformed into *I. orientalis* strain MeJi465 (supra) as described above. Transformants were plated onto ura selection media and incubated at 37° C., re-streaked onto ura selection media, and incubated at 37° C. overnight. URA3+ transformants were checked by PCR for integration of GAPN at scw11.

PCR was performed using the Phire® Plant Direct PCR kit (Finnzymes) according to the manufacturer's instructions. Primers 0611717 and 0615910 were designed to yield an approximately 1.4 kbp band by gel electrophoresis, while primers 0612908 and 0615911 were designed to yield an approximately 1.9 kbp band. Three strains which gave the expected bands for proper integration of the expression cassette were designated MBin558, MBin559 and MBin560. These strains are heterozygous at the scw11 locus for the *S. mutans* GAPN coding sequence of SEQ ID NO: 153 (encoding the GAPN of SEQ ID NO: 154) with expression driven by the PDC promoter and terminator from *I. orientalis*.

MBin596/597 (*L. delbrueckii* GAPN) & MBin598/599 (*Zea mays* GAPN)

Approximately 10 µg each of pMBin240 or pMBin241 from Example 3 was digested with ApaI and SacI and separated on a 1% agarose gel using TAE buffer. The desired approximately 5.7 kbp fragments were excised from the gel and purified using a QIAQUICK® Gel Extraction Kit (Qiagen) according to the manufacturer's instructions. Approximately 900 ng of the pMBin240 or pMBin241 fragment (digested with ApaI and SacI) was transformed into *I. orientalis* CNB1 MeJi465 (supra) as described above. Transformants were plated onto ura selection media and incubated at 37° C. for 2 days, re-streaked onto ura selection media, and incubated at 37° C. overnight. URA3+ transformants were checked by PCR for integration of GAPN at scw11.

PCR was performed using the Phire® Plant Direct PCR kit (Finnzymes) according to the manufacturer's instructions. Primers 0611717 and 0615910 were designed to yield an approximately 1.4 kbp band by gel electrophoresis, while primers 0612908 and 0615911 were designed to yield an approximately 1.9 kbp band. Two strains which gave the expected bands for proper integration of the *L. delbrueckii* expression cassette were designated MBin596, and MBin597. Two strains which gave the expected bands for proper integration of the *Z. mays* expression cassette were designated MBin598, and MBin599. These strains are heterozygous at the scw11 locus for the *L. delbrueckii* or *Z. mays* GAPN gene with expression driven by the PDC promoter and terminator from *I. orientalis*.

Example 5

Enzymatic Activity of Recombinant Yeast Strains Expressing a NADP-Dependent Glyceraldehyde-3-Phosphate Dehydrogenase (GAPN) Gene The recombinant yeast strains MBin558 (Example 4) and MeJi461 (Example 2) were each collected by centrifugation, the supernatants discarded, and the cell pellets stored at −20° C. Fermentation tanks were sampled at various time points with 16, 30, and 40 hr being assayed for enzymatic activity. For preparation of crude cell-free extracts (CFE), each cell pellet was thawed and resuspended to an equivalent OD600 of 25 with 1×PBS containing 1% Protease Inhibitor Cocktail, 04693159001 Roche). Each cell suspension was transferred to 2.0 mL microcentrifuge tubes with 2.4 g of Lysing Matrix Y (0.5 mm yttria-stabilized zirconium spheres, MP Biomedicals), and cell lysis was performed on FastPrep®-24 disruptor (MP Biomedicals) for 3 rounds at setting 6.5/50 seconds. Sample tubes were cooled on ice for 3 minutes between each round. After lysis, the samples were centrifuged at maximum speed in a microcentrifuge for 10 minutes at 4° C. The supernatants were transferred to fresh tubes and kept on ice or stored at −20° C. for future use. Total protein concentrations in the lysates were determined using the BCA Protein Assay Reagent Kit (bicinchoninic assay, Pierce Biotechnology) and bovine serum albumin as the standard, according to the instructions provided by the manufacturer.

NADP+ dependent glyceraldehyde-3-phosphate dehydrogenase (GAPN) activity in CFE of the indicated cells herein was determined as follows: A stock reaction mix solution was prepared that, when combined with CFE in the assay reaction mixture, provided the following: 100 mM Tris (pH 8.0); 1.5 mM NADP+; and 8 mM glyceraldehyde-3-phosphate. 190 µL of this mixture was added to the wells of a 96-well microtiter plate and 10 µL of an appropriately diluted CFE was added to start the reaction. Reduction of NADP+ was monitored at 340 nm using a SpectraMax 340 PC plate reader.

GAPN activity measured from yeast strains MBin558 and MeJi461 CFE at various time points is shown below in Table 3. Strain MBin558 (comprising an active 3-HP pathway and a heterologous polynucleotide encoding a GAPN), showed significantly more GAPN activity compared to corresponding strain MeJi461 (comprising the same active 3-HP pathway without the heterologous polynucleotide encoding a GAPN).

TABLE 3

| Time (hr) | GAPN activity (umol/min/g protein) | |
| --- | --- | --- |
|  | MBin558 | MeJi461 |
| 16 | 149.84 | 0.16 |
| 30 | 97.62 | 3.4 |
| 40 | 37.05 | 1.25 |

Figure 21:
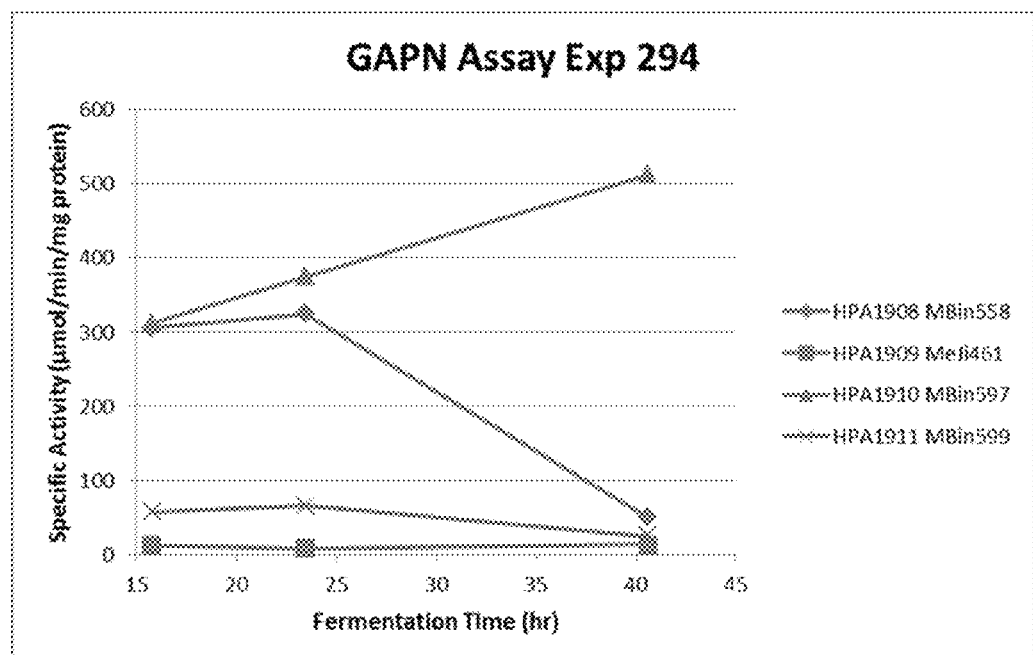
FIG. 21 shows a GAPN activity plot from several strains described herein.

Additional GAPN activity results from an experiment conducted with yeast strains MeJi461, MBin558, MBin597 and MBin599 are shown in FIG. 21. Yeast strains expressing an *S. mutans* GAPN (MBin558), *L. delbrueckii* GAPN (MBin597) or *Z. mays* GAPN (MBin599) each showed significantly more GAPN activity compared to corresponding strain lacking the heterologous polynucleotide encoding a GAPN (MeJi461).

Example 6

3-HP Production in Recombinant Yeast Strains Expressing a NADP+Dependent Glyceraldehyde-3-Phosphate Dehydrogenase (GAPN) Gene Recombinant yeast strains MeJi461 (Example 2) and recombinant yeast strains MBin558, MBin559, and MBin560 (Example 4) were cultivated using a seed propagation stage, followed by a single stage fermentation in a 3 L bioreactor (Applikon, Foster City, Calif., USA).

For seed stage preparation 25 mL of 1×DM2 medium (adjusted to the desired pH with KOH) was added to a 125 mL baffled flask, followed by inoculation with the strain of interest using a sterile loop. The culture was grown with shaking at 250 rpm at the desired temperature overnight for approximately 16 hr. Small aliquots of the culture were then withdrawn at approximately hourly intervals to measure the $OD_{600}$ until reaching an $OD_{600}$ of 4-6.

The residual glucose present was measured using a Uristix® Reagent Strip (Bayer, Elkhart, Ind., USA). 12 mL of the culture was then added to 4 mL of sterile chilled 75% glycerol, mix thoroughly, and incubated on ice for ten minutes. The culture and glycerol mixture was then remixed and 1.0 mL was aliquoted to each of 10 sterile 1.8 mL cryovials (Thermo Scientific, Rochester, N.Y., USA) and stored at −80° C.

25 mL of the seed flasks cultivation was used to inoculate the 3 L bioreactor containing 1.5 L of DM2 medium. The fermentation in the bioreactor was performed at a temperature of about 30° C.-40° C., with the pH controlled in the range of about 2.0-7.0 and under agitation and aeration conditions that lead to an oxygen uptake rate (OUR) in the range of 2-45 mmol/L/hr. In the examples presented herein, the temperature, pH and OUR for the culture in the bioreactor were 30° C., 4.0 and 10-25, respectively.

For analysis of 3-HP and β-Alanine, culture samples were removed and filtered through a 0.45 μm 96-well filter plate and further diluted 10× in 0.2% $NH_4OH$. Further dilution was made in water depending on analyte concentration in the sample. A further 10× dilution was made in a sample buffer of 20% MeOH, 1 mM $NH_4Ac$, 0.1% $NH_4OH$ and 15 mg/L of $^{13}C$ uniformly labeled 3-HP (as internal standard for 3-HP), or 20% MeOH, 1% formic acid and 3 mg/L of $^{13}C$ uniformly labeled β-alanine (as internal standard for β-alanine). The total dilution factor was approximately 100 to 1000 depending on the concentrations of β-alanine or 3-HP.

A 2 μL sample was injected into an Agilent 1200 HPLC (Agilent) controlled by MassHunter program with an Agilent 6410 Triple Quad MS/MS detector using the instrument settings and columns listed in Table 4. The ratio of the quantifying ion fragment peak area to its stable isotope counterpart (from internal standard) was used for quantification to eliminate ion suppression effect and instrument drifting. Standard deviation was below 5% from day to day assays.

TABLE 4

|  | 3-HP ($^{13}C$ 3-HP) | β-Alanine ($^{13}C$ β-Alanine) |
| --- | --- | --- |
| Column | Xbridge HILIC Silica 3.5 μm, 2.1 × 150 mm | Atlantis HILIC Silica 3 μm 2.1 × 150 mm |
| Elution buffer | 62% acetonitrile, 0.35 mM $NH_4Ac$ | 38% acetonitrile, 0.6% formic acid |
| Flow rate (mL/min) | 0.30 | 0.30 |
| Column temperature | 45° C. | 50° C. |
| Retention time (min) | 1.07 | 1.64 |
| Run time (min) | 3 | 3 |
| Precursor ion | 89 (92) | 90 (93) |
| Product ion as quantifier | 59 (61) | 72 (75) |
| Product ion as qualifier | 41 (43) | 30 (31) |
| Fragmentor Voltage | 50 | 70 |
| Collision energy | 5 for quantifier; 21 for qualifier | 3 for quantifier; 7 for qualifier |
| Polarity | Negative | Positive |
| Nebulizer $N_2$ pressure (psi) | 10 | 10 |
| $N_2$ flow (L/min) | 32 | 32 |
| $N_2$ temperature | 300° C. | 300° C. |
| Capillary (V) | 4000 | 4000 |
| Delta EMV | 450 | 450 |

Glucose consumed was measured following the protocol of a commercially available kit: "Liquid Glucose Oxidase Reagent Set" (Pointe Scientific, Inc).

Figure 17:
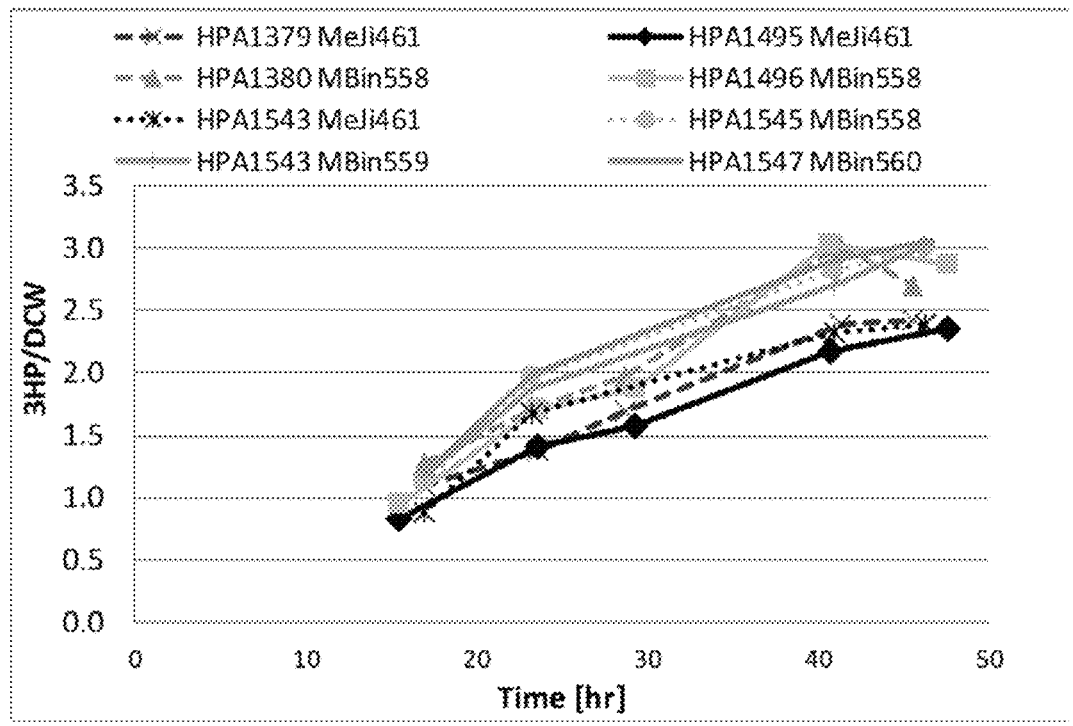
FIG. 17 shows a fermentation plot of 3-HP/DCW.
Figure 18:
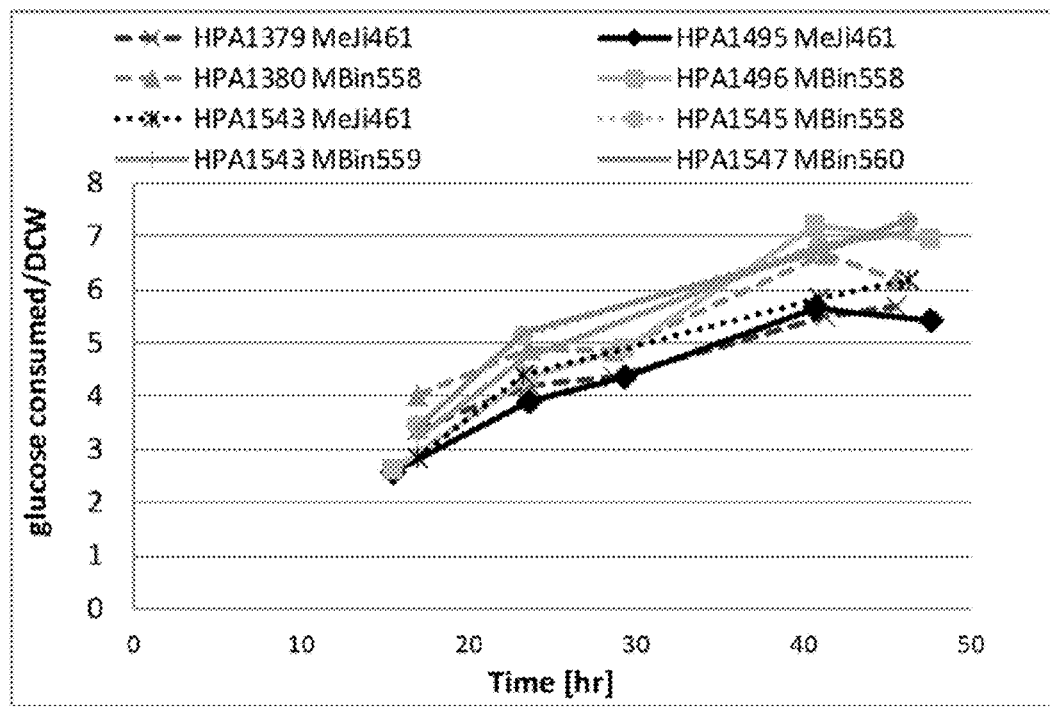
FIG. 18 shows a fermentation plot of glucose consumed/DCW.

The resulting fermentation for strains MeJi461, MBin558, MBin559, and MBin560 at various time points is shown in FIG. 17 (3-HP/DCW) and 18 (glucose consumed/DCW). Specific results of 3-HP fermentation and glucose consumption at 41 hours and 46 hours are shown in Tables 5 and 6, respectively. Yeast strains MBin558, MBin559, and MBin560 (comprising an active 3-HP pathway and a heterologous polynucleotide encoding a GAPN), showed significant improvement in both 3-HP production and glucose consumption compared to corresponding strain MeJi461 (comprising the same active 3-HP pathway without the heterologous polynucleotide encoding a GAPN).

TABLE 5

| 41 hrs | Repeats | 3HP/DCW | | | Glu consumed/DCW | | |
| --- | --- | --- | --- | --- | --- | --- | --- |
|  |  | AVE | % improvement | STD | AVE | % improvement | STD |
| MeJi461 | 3 | 2.30 | NA | 0.11 | 5.66 | NA | 0.18 |
| MBin558 | 3 | 2.96 | 129 | 0.12 | 6.91 | 122 | 0.28 |
| MBin559 | 1 | 2.71 | 118 | NA | 6.83 | 121 | NA |
| MBin560 | 1 | 2.90 | 127 | NA | 6.69 | 118 | NA |

TABLE 6

| 46 hrs | Repeats | 3HP/DCW | | | Glu consumed/DCW | | |
|---|---|---|---|---|---|---|---|
| | | AVE | % improvement | STD | AVE | % improvement | STD |
| MeJi461 | 3 | 2.39 | NA | 0.04 | 5.77 | NA | 0.40 |
| MBin558 | 3 | 2.85 | 120 | 0.15 | 6.81 | 118 | 0.57 |
| MBin559 | 1 | 3.01 | 126 | NA | 7.07 | 123 | NA |
| MBin560 | 1 | 3.05 | 128 | NA | 7.30 | 127 | NA |

Additional comparisons of fermentation experiments conducted as described above for recombinant yeast strains MeJi461, MBin558, MBin559, MBin560, MBin596, MBin597, MBin598, and MBin599 after 46 hrs are shown below in Table 7.

TABLE 7

| Strain | GAPN | Repeats | 3HP/DCW | | | | Glu consumed/DCW | | | |
|---|---|---|---|---|---|---|---|---|---|---|
| | | | AVE | % improvement | STD | P value | AVE | % improvement | STD | P value |
| MeJi461 | None | 11 | 2.44 | NA | 0.22 | NA | 5.81 | NA | 0.74 | NA |
| MBin558/559/560 | S. mutans | 11 | 2.90 | 119 | 0.25 | 0.000 | 7.04 | 121 | 0.62 | 0.000 |
| MBin596/597 | L. delbrueckii | 2 | 2.98 | 122 | 0.17 | 0.009 | 7.85 | 135 | 1.00 | 0.005 |
| MBin598/599 | Z. mays | 2 | 2.82 | 115 | 0.41 | 0.073 | 7.16 | 123 | 0.11 | 0.028 |

Yeast strains comprising an active 3-HP pathway and expressing an S. mutans GAPN (MBin558/559/560), L. delbrueckii GAPN (MBin596/597) or Z. mays GAPN (MBin598/599) each showed significant improvement in both 3-HP production and glucose consumption compared to corresponding strain MeJi461 (comprising the same active 3-HP pathway without the heterologous polynucleotide encoding a GAPN).

Although the foregoing has been described in some detail by way of illustration and example for the purposes of clarity of understanding, it is apparent to those skilled in the art that any equivalent aspect or modification may be practiced. Therefore, the description and examples should not be construed as limiting the scope of the invention.

In some aspects, the invention may be described by the following numbered paragraphs:

[1] A recombinant yeast cell comprising an active 3-HP pathway, wherein the cell comprises a heterologous polynucleotide encoding a non-phosphorylating NADP-dependent glyceraldehyde-3-phosphate dehydrogenase (GAPN); and wherein the cell is capable of producing 3-HP.

[2] The recombinant yeast cell of paragraph [1], wherein the heterologous polynucleotide encoding the non-phosphorylating NADP-dependent glyceraldehyde-3-phosphate dehydrogenase (GAPN) comprises a promoter foreign to GAPN coding sequence.

[3] The recombinant yeast cell of paragraph [1] or [2], wherein the cell produces a greater amount of 3-HP compared to the cell without the heterologous polynucleotide encoding the non-phosphorylating NADP-dependent glyceraldehyde-3-phosphate dehydrogenase (GAPN), when cultivated under identical conditions.

[4] The recombinant yeast cell of paragraph [3], wherein the cell is capable of producing at least 10% more (e.g., at least 15%, at least 20%, at least 25%, at least 30%, at least 35%, at least 40%, at least 45%, at least 50%, at least 75%, at least 100%, or at least 200% more) 3-HP compared to the cell without the heterologous polynucleotide encoding the non-phosphorylating NADP-dependent glyceraldehyde-3-phosphate dehydrogenase (GAPN), when cultivated under identical conditions.

[5] The recombinant yeast cell of any of paragraphs [1]-[4], wherein the non-phosphorylating NADP-dependent glyceraldehyde-3-phosphate dehydrogenase (GAPN) has at least 50%, e.g., at least 55%, 60%, 65%, 70%, 75%, 80%, 85%, 90%, 95%, 97%, 98%, 99%, or 100% sequence identity to the amino acid sequence of SEQ ID NO: 154, 155, 156, 157, 158, 159, 160, 161, 162, 189, 190, 192, or 194.

[6] The recombinant yeast cell of any of paragraphs [1]-[4], wherein the non-phosphorylating NADP-dependent glyceraldehyde-3-phosphate dehydrogenase (GAPN) has an amino acid sequence comprising or consisting of SEQ ID NO: 154, 155, 156, 157, 158, 159, 160, 161, 162, 189, 190, 192, or 194.

[7] The recombinant yeast cell of any of paragraphs [1]-[6], wherein the cell comprises one or more heterologous polynucleotides selected from:
a heterologous polynucleotide encoding a PPC;
a heterologous polynucleotide encoding a PYC;
a heterologous polynucleotide encoding an AAT;
a heterologous polynucleotide encoding an ADC;
a heterologous polynucleotide encoding a BAAT or gabT; and
a heterologous polynucleotide encoding a 3-HPDH;

[8] The recombinant yeast cell of paragraph [7], wherein the cell comprises a heterologous polynucleotide encoding a PYC.

[9] The recombinant yeast cell of paragraph [7], wherein the PYC has at least 60%, e.g., at least 65%, 70%, 75%, 80%, 85%, 90%, 95%, 97%, 98%, 99%, or 100% sequence identity to the amino acid sequence of SEQ ID NO: 2, 3, 4, 5, 6, 7, or 8.

[10] The recombinant yeast cell of paragraph [7], wherein the PYC has an amino acid sequence comprising or consisting of SEQ ID NO: 2, 3, 4, 5, 6, 7, or 8.

[11] The recombinant yeast cell of any of paragraphs [7]-[10], wherein the cell comprises a heterologous polynucleotide encoding an AAT.

[12] The recombinant yeast cell of paragraph [11], wherein the AAT has at least 60%, e.g., at least 65%, 70%, 75%, 80%, 85%, 90%, 95%, 97%, 98%, 99%, or 100% sequence identity to the amino acid sequence of SEQ ID NO: 14, 15, or 16.

[13] The recombinant yeast cell of paragraph [11], wherein the AAT has an amino acid sequence comprising or consisting of SEQ ID NO: 14, 15, or 16.

[14] The recombinant yeast cell of any of paragraphs [7]-[13], wherein the cell comprises a heterologous polynucleotide encoding an ADC.

[15] The recombinant yeast cell of paragraph [14], wherein the ADC has at least 60%, e.g., at least 65%, 70%, 75%, 80%, 85%, 90%, 95%, 97%, 98%, 99%, or 100% sequence identity to the amino acid sequence of SEQ ID NO: 17, 18, 133, 135, 137, or 139.

[16] The recombinant yeast cell of paragraph [14], wherein the ADC has an amino acid sequence comprising or consisting of SEQ ID NO: 17, 18, 133, 135, 137, or 139.

[17] The recombinant yeast cell of any of paragraphs [7]-[16], wherein the cell comprises a heterologous polynucleotide encoding a BAAT or gabT.

[18] The recombinant yeast cell of paragraph [17], wherein the BAAT or gabT has at least 60%, e.g., at least 65%, 70%, 75%, 80%, 85%, 90%, 95%, 97%, 98%, 99%, or 100% sequence identity to the amino acid sequence of SEQ ID NO: 20, 21, 22, 23, or 24.

[19] The recombinant yeast cell of paragraph [17], wherein the BAAT or gabT has an amino acid sequence comprising or consisting of SEQ ID NO: 20, 21, 22, 23, or 24.

[20] The recombinant yeast cell of any of paragraphs [17]-[19], wherein said BAAT or gabT is a BAAT that is also a gabT.

[21] The recombinant yeast cell of any of paragraphs [7]-[20], wherein the cell comprises a heterologous polynucleotide encoding a 3-HPDH (e.g. a 3-HPDH that utilizes NADPH).

[22] The recombinant yeast cell of paragraph [21], wherein the 3-HPDH has at least 60%, e.g., at least 65%, 70%, 75%, 80%, 85%, 90%, 95%, 97%, 98%, 99%, or 100% sequence identity to the amino acid sequence of SEQ ID NO: 26, 27, 28, 29, 30, 31, 32, 33, 34, or 129.

[23] The recombinant yeast cell of paragraph [21], wherein the 3-HPDH has an amino acid sequence comprising or consisting of SEQ ID NO: 26, 27, 28, 29, 30, 31, 32, 33, 34, or 129.

[24] The recombinant yeast cell of any of paragraphs [21]-[23], wherein the 3-HPDH is also a HIBADH.

[25] The recombinant yeast cell of any of paragraphs [21]-[23], wherein the 3-HPDH is also a 4-hydroxybutyrate dehydrogenase.

[26] The recombinant yeast cell of any of paragraphs [7]-[25], wherein the cell comprises a heterologous polynucleotide encoding a PPC.

[27] The recombinant yeast cell of paragraph [26], wherein the PPC has at least 60%, e.g., at least 65%, 70%, 75%, 80%, 85%, 90%, 95%, 97%, 98%, 99%, or 100% sequence identity to the amino acid sequence of SEQ ID NO: 10, 11, or 12.

[28] The recombinant yeast cell of paragraph [26], wherein the PPC has an amino acid sequence comprising or consisting of SEQ ID NO: 10, 11, or 12.

[29] The recombinant yeast cell of any of paragraphs [1]-[28], wherein said yeast cell is Crabtree-negative.

[30] The recombinant yeast cell of any of claims [1]-[29], wherein the yeast cell belongs to a genus selected from *Issatchenkia*, *Candida*, *Kluyveromyces*, *Pichia*, *Schizosaccharomyces*, *Torulaspora*, *Zygosaccharomyces*, and *Saccharomyces*.

[31] The recombinant yeast cell of paragraph [30], wherein the yeast cell belongs to a clade selected from the *I. orientalisi/P. fermentans* clade and the *Saccharomyces* clade.

[32] The recombinant yeast cell of paragraph [30], wherein the yeast cell is selected from *I. orientalis*, *C. lambica*, and *S. bulderi*.

[33] The recombinant yeast cell of paragraph [32], wherein the yeast cell is an *I. orientalis* yeast cell.

[34] The recombinant yeast cell of paragraph [33], wherein the yeast cell is an *I. orientalis* CNB1 yeast cell.

[35] The recombinant yeast cell of any one of paragraphs [1]-[34], wherein the yeast cell is unable to ferment pentose sugars.

[36] The recombinant yeast cell of any of paragraphs [1]-[35], wherein said cell further comprises a disruption to one or more endogenous genes encoding a PDC, ADH, GALE, CYB2A, CYB2B, GPD, GPP, ALD, or PCK.

[37] The recombinant yeast cell of paragraph [36], wherein said cell further comprises a disruption to an endogenous gene encoding a PDC.

[38] The recombinant yeast cell of paragraph [37], wherein the cell comprises a disruption to an endogenous gene encoding a PDC having at least 75%, e.g., at least 80%, at least 85%, at least 90%, at least 95%, at least 97%, at least 98%, at least 99%, or 100% sequence identity to SEQ ID NO: 186.

[39] The recombinant yeast cell of paragraph [37], wherein the cell comprises a disruption to an endogenous gene encoding a PDC having an amino acid sequence comprising or consisting of SEQ ID NO: 186.

[40] The recombinant yeast cell of any of paragraphs [36]-[39], wherein the coding sequence of the gene encoding the PDC has at least 75%, e.g., at least 80%, at least 85%, at least 90%, at least 95%, at least 97%, at least 98%, at least 99%, or 100% sequence identity to SEQ ID NO: 185.

[41] The recombinant yeast cell of any of paragraphs [36]-[39], wherein the coding sequence of the endogenous gene encoding the PDC comprises or consists of SEQ ID NO: 185.

[42] The recombinant yeast cell of any of paragraphs [37]-[41], wherein the disruption to the endogenous gene encoding the PDC occurs in the coding sequence of the gene encoding the PDC.

[43] The recombinant yeast cell of any of paragraphs [37]-[41], wherein the disruption to the endogenous gene encoding the PDC occurs in a promoter sequence of the gene encoding the PDC.

[44] The recombinant yeast cell of any of paragraphs [37]-[43], wherein the cell produces at least 25% less (e.g., at least 50% less, at least 60% less, at least 70% less, at least 80% less, or at least 90% less) of the PDC compared to the cell without the disruption when cultivated under identical conditions.

[45] The recombinant yeast cell of any of paragraphs [37]-[44], wherein the endogenous gene encoding the PDC is inactivated.

[46] The recombinant yeast cell of any of paragraphs [37]-[45], wherein the cell produces a decreased amount of ethanol (e.g., at least 25% less, at least 50% less, at least 60% less, at least 70% less, at least 80% less, or at least 90% less) compared to the cell without the disruption to the endogenous gene encoding the PDC when cultivated under identical conditions.

[47] The recombinant yeast cell of any of paragraphs [37]-[46], wherein the cell produces a greater amount of 3-HP compared to the cell without the disruption to the endogenous gene encoding the PDC when cultivated under identical conditions.

[48] The recombinant yeast cell of any of paragraphs [37]-[47], wherein the cell is capable of producing at least 10% more (e.g., at least 15%, at least 20%, at least 25%, at least 30%, at least 35%, at least 40%, at least 45%, at least 50%, at least 75%, at least 100%, or at least 200% more) 3-HP compared to the cell without the disruption to the endogenous gene encoding the PDC, when cultivated under identical conditions.

[49] The recombinant yeast cell of any of paragraphs [37]-[48], wherein said cell further comprises a disruption to an endogenous gene encoding a GPD.

[50] The recombinant yeast cell of paragraph [49], wherein the cell comprises a disruption to an endogenous gene encoding a GPD having at least 75%, e.g., at least 80%, at least 85%, at least 90%, at least 95%, at least 97%, at least 98%, at least 99%, or 100% sequence identity to SEQ ID NO: 188.

[51] The recombinant yeast cell of paragraph [49], wherein the cell comprises a disruption to an endogenous gene encoding a GPD having an amino acid sequence comprising or consisting of SEQ ID NO: 188.

[52] The recombinant yeast cell of any of paragraphs [49]-[51], wherein the coding sequence of the gene encoding the GPD has at least 75%, e.g., at least 80%, at least 85%, at least 90%, at least 95%, at least 97%, at least 98%, at least 99%, or 100% sequence identity to SEQ ID NO: 187.

[53] The recombinant yeast cell of any of paragraphs [49]-[51], wherein the coding sequence of the endogenous gene encoding the GPD comprises or consists of SEQ ID NO: 187.

[54] The recombinant yeast cell of any of paragraphs [49]-[53], wherein the disruption to the endogenous gene encoding the GPD occurs in the coding sequence of the gene encoding the GPD.

[55] The recombinant yeast cell of any of paragraphs [49]-[53], wherein the disruption to the endogenous gene encoding the GPD occurs in a promoter sequence of the gene encoding the GPD.

[56] The recombinant yeast cell of any of paragraphs [49]-[55], wherein the cell produces at least 25% less (e.g., at least 50% less, at least 60% less, at least 70% less, at least 80% less, or at least 90% less) of the GPD compared to the cell without the disruption when cultivated under identical conditions.

[57] The recombinant yeast cell of any of paragraphs [49]-[56], wherein the endogenous gene encoding the GPD is inactivated.

[58] The recombinant yeast cell of any of paragraphs [49]-[57], wherein the cell produces a decreased amount of glycerol (e.g., at least 25% less, at least 50% less, at least 60% less, at least 70% less, at least 80% less, or at least 90% less) compared to the cell without the disruption to the endogenous gene encoding the GPD when cultivated under identical conditions.

[59] The recombinant yeast cell of any of paragraphs [49]-[58], wherein the cell produces a greater amount of 3-HP compared to the cell without the disruption to the endogenous gene encoding the PDC when cultivated under identical conditions.

[60] The recombinant yeast cell of paragraph [49]-[59], wherein the cell is capable of producing at least 10% more (e.g., at least 15%, at least 20%, at least 25%, at least 30%, at least 35%, at least 40%, at least 45%, at least 50%, at least 75%, at least 100%, or at least 200% more) 3-HP compared to the cell without the disruption to the endogenous gene encoding the PDC, when cultivated under identical conditions.

[61] The recombinant yeast cell of any of paragraphs [1]-[60], wherein the cell is capable of growing at a pH of less than 4 in media containing 75 g/L or greater 3-HP.

[62] The recombinant yeast cell of any of paragraphs [1]-[61], wherein the cell is a 3-HP-resistant yeast cell.

[63] The recombinant yeast cell of any of paragraphs [1]-[62], wherein the cell has undergone mutation and/or selection, such that the mutated and/or selected cell possess a higher degree of resistance to 3-HP than a wild-type cell of the same species.

[64] The recombinant yeast cell of paragraph [63], wherein the cell has undergone mutation and/or selection before being genetically modified with the heterologous polynucleotide encoding a non-phosphorylating NADP-dependent glyceraldehyde-3-phosphate dehydrogenase (GAPN).

[65] The recombinant yeast cell of paragraph [63] or [64], wherein the cell has undergone selection in the presence of lactic acid or 3-HP.

[66] The recombinant yeast cell of paragraph [65], wherein the selection is chemostat selection.

[67] A composition comprising the recombinant host cell of any of paragraphs [1]-[66].

[68] The composition of paragraph [67], wherein the composition comprises a fermentable medium.

[69] The composition of paragraph [68], wherein the fermentable medium comprises sucrose, glucose, and/or fructose.

[70] The composition of any of paragraphs [67]-[69], wherein the fermentable medium comprises less than 1% pentose sugars.

[71] The composition of any of paragraphs [67]-[70], further comprising 3-HP.

[72] The composition of paragraph [71], wherein the 3-HP is at a titer greater than about 1 g/L, e.g., greater than about 2 g/L, 5 g/L, 10 g/L, 15 g/L, 20 g/L, 25 g/L, 30 g/L, 35 g/L, 40 g/L, 45 g/L, 50 g/L, 55 g/L, 60 g/L, 65 g/L, 70 g/L, 75 g/L, 80 g/L, 85 g/L, 90 g/L, 95 g/L, 100 g/L, 125 g/L, 150 g/L, 200 g/L, or 250 g/L.

[73] The composition of any of paragraphs [68]-[72], wherein the medium is at a pH of less than 5, e.g., in the range of about 1.5 to about 4.5, about 2.0 to about 4.0, or about 2.0 to about 3.5.

[74] A method of producing 3-HP, comprising:
  (a) cultivating the recombinant yeast cell of any of paragraphs [1]-[66] in a fermentable medium under suitable conditions to produce 3-HP; and
  (b) recovering the 3-HP.

[75] The method of paragraph [74], wherein the fermentable medium comprises sucrose, glucose, and/or fructose.

[76] The method of paragraph [74] or [75], wherein the fermentable medium comprises less than 1% pentose sugars.

[77] The method of any of paragraphs [74]-[76], wherein the produced 3-HP is at a titer greater than about 1 g/L, e.g., greater than about 2 g/L, 5 g/L, 10 g/L, 15 g/L, 20 g/L, 25 g/L, 30 g/L, 35 g/L, 40 g/L, 45 g/L, 50 g/L, 55 g/L, 60 g/L, 65 g/L, 70 g/L, 75 g/L, 80 g/L, 85 g/L, 90 g/L, 95 g/L, 100 g/L, 125 g/L, 150 g/L, 200 g/L, or 250 g/L.

[78] The method of any of paragraphs [74]-[77], wherein the resulting 3-HP is substantially pure.

[79] The method of any of paragraphs [77]-[78], wherein the fermentable medium is at a pH of less than 5, e.g., in the range of about 1.5 to about 4.5, about 2.0 to about 4.0, or about 2.0 to about 3.5.

[80] A method of producing acrylic acid or a salt thereof, comprising:
  (a) cultivating the recombinant yeast cell of any of paragraphs [1]-[66] in a fermentable medium under suitable conditions to produce 3-HP;
  (b) recovering the 3-HP;
  (c) dehydrating the 3-HP under suitable conditions to produce acrylic acid or a salt thereof; and
  (d) recovering the acrylic acid or salt thereof.

[81] The method of any one of paragraphs [74]-[80] wherein the recombinant yeast cell is an *I. orientalis* CNB1 yeast cell cultivated in a fermentable medium comprising less than 1% pentose sugars.

SEQUENCE LISTING (194 sequences)

SEQ ID NO: 1 - DNA, 3543 bp, Issatchenkia orientalis
atgtcaactgtggaagatcactcctccctacataaattgagaaaggaatctgagattctttccaatgcaaacaaaatcttagtggctaatagaggtgaaattccaattagaattttcaggtcagcccatgaattgtcaatgcatactgtggcgatctattcccatgaagatcggttgtccatgcataggttgaaggccgacgaggcttatgcaatcggtaagactggtcaatattcgccagttcaagcttatctacaaattgacgaaattatcaaaatagcaaaggaacatgatgtttccatgatccatccaggttatggtttcttatctgaaaactccgaattcgcaaagaaggttgaagaatccggtatgatttgggttgggcctcctgctgaagttattgattctgttggtgacaaggtttctgcaagaaatttggcaattaaatgtgacgttcctgttgttcctggtaccgatggtccaattgaagacattgaacaggctaaacagtttgtggaacaatatggttatcctgtcattataaaggctgcatttggtggtggtggtagaggtatgagagttgttagagaaggtgatgatatagttgatgctttccaaagagcgtcatctgaagcaaagtctgcctttggtaatggtacttgttttattgaaagatttttggataagccaaaacatattgaggttcaattattggctgataattatggtaacacaatccatctctttgaaagagattgttctgttcaaagaagacatcaaaaggttgttgaaattgcacctgccaaaactttacctgttgaagttagaaatgctatattaaaggatgctgtaacgttagctaaaaccgctaactatagaaatgctggtactgcagaatttttagttgattcccaaaacagacattattttattgaaattaatccaagaattcaagttgaacatacaattactgaagaaatcacgggtgttgatattgttgccgctcaaattcaaattgctgcaggtgcatcattggaacaattgggtctattacaaaacaaaattacaactagaggttttgcaattcaatgtagaattacaaccgaggatcctgctaagaattttgccccagatacaggtaaaattgaggtttatagatctgcaggtggtaacggtgtcagattagatggtggtaatgggtttgccggtgctgttatatctcctcattatgactcgatgttggttaaatgttcaacatctggttctaactatgaaattgccagaagaaagatgattagagctttagttgaatttagaatcagaggtgtcaagaccaatattcctttcttattggcattgctaactcatccagttttcatttcgggtgattgttggacaacttttattgatgataccccttcgttattcgaaatggtttcttcaaagaatagagcccaaaaattattggcatatattggtgacttgtgtgtcaatggttcttcaattaaaggtcaaattggtttccctaaattgaacaaggaagcagaaatcccagatttgttggatccaaatgatgaggttattgatgtttctaaaccttctaccaatggtctaagaccgtatctattaaagtatggaccagatgcgttttccaaaaaagttcgtgaattcgatggttgtatgattatggataccacctggagagatgcacatcaatcattattggctacaagagttagaactattgatttactgagaattgctccaacgactagtcatgccttacaaaatgcatttgcattagaatgttggggtggcgcaacatttgatgttgcgatgaggttcctctatgaagatccttgggagagattaagacaacttagaaaggcagttccaaatattcctttccaaatgttattgagaggtgctaatggtgttgcttattcgtcattacctgataatgcaattgatcattttgttaagcaagcaaaggataatggtgttgatattttcagagtctttgatgctttgaacgatttggaacaattgaaggttggtgttgatgctgtcaagaaagccggaggtgttgttgaagctacagtttgttactcaggtgatatgttaattccaggtaaaaagtataacttggattattatttagagactgttggaaagattgtggaaatgggtacccatattttaggtattaaggatatggctggcacgttaaagccaaaggctgctaagttgttgattggctcgatcagatcaaaataccctgacttggttatccatgtccatacccatgactctgctggtaccggtatttcaacttatgttgcatgcgcattggcaggtgccgacattgtcgattgtgcaatcaattcgatgtctggtttaacctctcaaccttcaatgagtgcttttattgctgctttagatggtgatatcgaaactggtgttccagaacattttgcaagacaattagatgcatactgggcagaaatgagattgttatactcatgtttcgaagccgacttgaagggaccagacccagaagtttataaacatgaaattccaggtggacagttgactaacctaatcttccaagcccaacaagttggtttgggtgaacaatgggaagaaactaagaagaagtatgaagatgctaacatgttgttgggtgatattgtcaaggttaccccaacctccaaggttgttggtgatttagcccaatttatggtttctaataaattagaaaaagaagatgttgaaaaacttgctaatgaattagatttcccagattcagttcttgatttctttgaaggattaatgggtacaccatatggtggattcccagagcctttgagaacaaatgtcatttccggcaagagaagaaaattaaagggtagaccaggtttagaattagaacctttcaacctcgaggaaatcagagaaaatttggtttccagatttggtccaggtattactgaatgtgatgttgcatcttataacatgtatccaaaggtttacgagcaatatcgtaaggtggttgaaaaatatggtgatttatctgttttaccaacaaaagcatttttggctcctccaactattggtgaagaagttcatgtggaaattgagcaaggtaagactttgattattaagttattagccatttctgacttgtctaaatctcatggtacaagagaagtatactttgaattgaatggtgaaatgagaaaggttacaattgaagataaaacagctgcaattgagactgttacaagagcaaaggctgacggacacaatccaaatgaagttggtgcgccaatggctggtgtcgttgttgaagttagagtgaagcatggaacagaagttaagaagggtgatccattagccgttttgagtgcaatgaaaatggaaatggttatttctgctcctgttagtggtagggtcggtgaagtttttgtcaacgaaggcgattccgttgatatgggtgatttgcttgtgaaaattgccaaagatgaagcgccagcagcttaa

SEQ ID NO: 2 - protein, 1180 aa, Issatchenkia orientalis
MSTVEDHSSLHKLRKESEILSNANKILVANRGEIPIRIFRSAHELSMHTVAIYSHEDRLSMHRLKADEAYAIGKTGQYSPVQAYLQIDEIIKIAKEHDVSMIHPGYGFLSENSEFAKKVEESGMIWVGPPAEVIDSVGDKVSARNLAIKCDVPVVPGTDGPIEDIEQAKQFVEQYGYPVIIKAAFGGGGRGMRVVREGDDIVDAFQRASSEAKSAFGNGTCFIERFLDKPKHIEVQLLADNYGNTIHLFERDCSVQRRHQKVVEIAPAKTLPVEVRNAILKDAVTLAKTANYRNAGTAEFLVDSQNRHYFIEINPRIQVEHTITEEITGVDIVAAQIQIAAGASLEQLGLLQNKITTRGFAIQCRITTEDPAKNFAPDTGKIEVYRSAGGNGVRLDGGNGFAGAVISPHYDSMLVKCSTSGSNYEIARRKMIRALVEFRIRGVKTNIPFLLALLTHPVFISGDCWTTFIDDTPSLFEMVSSKNRAQKLLAYIGDLCVNGSSIKGQIGFPKLNKEAEIPDLLDPNDEVIDVSKPSTNGLRPYLLKYGPDAFSKKVREFDGCMIMDTTWRDAHQSLLATRVRTIDLLRIAPTTSHALQNAFALECWGGATFDVAMRFLYEDPWERLRQLRKAVPNIPFQMLLRGANGVAYSSLPDNAIDHFVKQAKDNGVDIFRVFDALNDLEQLKVGVDAVKKAGGVVEATVCYSGDMLIPGKKYNLDYYLETVGKIVEMGTHILGIKDMAGTLKPKAAKLLIGSIRSKYPDLVIHVHTHDSAGTGISTYVACALAGADIVDCAINSMSGLTSQPSMSAFIAALDGDIETGVPEHFARQLDAYWAEMRLLYSCFEADLKGPDPEVYKHEIPGGQLTNLIFQAQQVGLGEQWEETKKKYEDANMLLGDIVKVTPTSKVVGDLAQFMVSNKLEKEDVEKLANELDFPDSVLDFFEGLMGTPYGGFPEPLRTNVISGKRRKLKGRPGLELEPFNLEEIRENLVSRFGPGITECDVASYNMYPKVYEQYRKVVEKYGDLSVLPTKAFLAPPTIGEEVHVEIEQGKTLIIKLLAISDLSKSHGTREVYFELNGEMRKVTIEDKTAAIETVTRAKADGHNPNEVGAPMAGVVVEVRVKHGTEVKKGDPLAVLSAMKMEMVISAPVSGRVGEVFVNEGDSVDMGDLLVKIAKDEAPAA

SEQ ID NO: 3 - protein, 1154 aa, Rhodobacter sphaeroides
MAEFRKILIANRGEIAIRVMRAANEMGKKTVAVYAEEDKLSLHRFKADEAYRIGEGLSPVGAYLSIPEIIRVAQMSGADAIHPGYGLLSENPDFVEACDAAGIAFIGPKAETMRALGDKASARRVAMAAGVPVIPATEVLGDDMEEIKRQAAEIGYPLMLKASWGGGGRGMRPITSEAELADKVREGRREAEAAFGNGEGYLEKMIQRARHVEVQILGDKYGAIYHLYERDCTVQRRNQKVVERAPAPYLTEEQRTEICELGRRICAHVNYECAGTVEFLMDMDSEKFYFIEVNPRVQVEHTVTEEVTGIDIVQSQIRIAEGATLAEATGCPSQDDIKLSGHALQCRVTTEDPQNNFIPDYGRLTAYRSATGMGIRLDGGTAYAGGVITRYYDSLLVKVTAWAPTPEKAIARMDRALREFRIRGVATNIAFVENLLKHPSFLDYSYTTKFIDTTPDLFNFKPRRDRATKILTYIADITVNGHPETAGRVRPSAELKDPKAPEPKGAPQPGTRTLLEEKGPQAVADWMAAQTRVLMTDTTMRDGHQSLLATRMRSIDMIKVTPAYAANLGGLFSVECWGGATFDVAYRFLQECPWQRLRDIRARLPNVMTQMLLRASNGVGYTNYPDNVVQEFVRQAAETGVDVFRVFDSLNWVENMRVAMDAVIEANKVCEGTICYTGDLLDPDRSKYDLNYYVGMGRALRDAGAHVLGLKDMAGLLKPAAARVLVKALKEEVGLPIHFHTHDTSGIAGATVLAACDAGVDAVDAAMDAFSGGTSQPCLGSIVEALKHTDRDTGLDIAAIREISDYWGHVRQQYSAFESGLPSPASEVYLHEMPGGQFTNLKAQARSMGLEERWSEVAQAYADANRMFGDIVKVTPSSKVVGDMALMMVAQGLTREEVEDPEVEVSFPDSVVDMLKGNLGQPHGGWPEPILKKVLKGEAPSTERPGAHLPPVDIAAAREKLLSEIKQGDDDPLDTAVDAEDLNGYLMYPKVFTDYRARHRIYGPVRTLPTRTFFYGMEPGEEISAEIDPGKTLEIRLSAVGETSDDGDAKVFFELNGQPRVIRVANRAVKAKTATRPKAQDGNPAHVGAPMPGSVASVAVSAGQKVKPGDLLVTIEAMKMETGLHADRAATVKAVHVGPGAQIEAKDLLVELED

SEQ ID NO: 4 - protein, 1154 aa, Rhizobium etli
MPISKILVANRSEIAIRVFRAANELGIKTVAIWAEEDKLALHRFKADESYQVGRGPHLARDLGPIESYLSIDEVIRVAKLSGADAIHPGYGLLSESPEFVDACNKAGIIFIGPKADTMRQLGNKVAARNLAISVGVPVVPATEPLPDDMAEVAKMAAAIGYPVMLKASWGGGGRGMRVIRSEADLAKEVTEAKREAMAAFGKDEVYLEKLVERARHVESQILGDTHGNVVHLFERDCSVQRRNQKVVERAPAPYLSEAQRQELAAYSLKIAGATNYIGAGTVEYLMDADTGKFYFIEVNPRIQVEHTVTEVVTGIDIVKAQIHILDGAAIGTPQSGVPNQEDIRLNGHALQCRVTTEDPEHNFIPDYGRITAYRSASGFGIRLDGGTSYSGAIITRYYDPLLVKVTAWAPNPLEAISRMDRALREFRIRGVATNLTFLEAIIGHPKFRDNSYTTRFIDTTPELFQQVKRQDRATKLLTYLADVTVNGHPEAKDRPKPLENAARPVVPYANGNGVKDGTKQLLDTLGPKKFGEWMRNEKRVLLTDTTMRDGHQSLLATRMRTYDIARIAGTYSHALPNLLSLECWGGATFDVSMRFLTEDPWERLALIREGAPNLLLQMLLRGANGVGYTNYPDNVVKYFVRQAAKGGIDLFRVFDCLNWVENMRVSMDAIAEENKLCEAAICYTGDILNSARPKYDLKYYTNLAVELEKAGAHIIAVKDMAGLLKPAAAKVLFKALREATGLPIHFHTHDTSGIAAATVLAAVEAGVDAVDAAMDALSGNTSQPCLGSIVEALSGSERDPGLDPAWIRRISFYWEAVRNQYAAFESDLKGPASEVYLHEMPGGQFTNLKEQARSLGLETRWHQVAQAYADANQMFGDIVKVTPSSKVVGDMALMMVSQDLTVADVVSPDREVSFPESVVSMLKGDLGQPPSGWPEALQKKALKGEKPYTVRPGSLLKEADLDAERKVIEKKLEREVSDFEFASYLMYPKVFTDFALASDTYGPVSVLPTPAYFYGLADGEELFADIEKGKTLVIVNQAVSATDSQGMVTVFFELNGQPRRIKVPDRAHGATGAAVRRKAEPGNAAHVGAPMPGVISRVFVSSGQAVNAGDVLVSIEAMKMETAIHAEKDGTIAEVLVKAGDQIDAKDLLAVYGG

SEQ ID NO: 5 - protein, 602 aa, Pseudomonas fluorescens
MTKKIFVTDTILRDAHQSLLATRMRTEDMLPICDKLDKVGYWSLECWGGATFDACVRFLKEDPWERLRQLRAALPNTRLQMLLRGQNLLGYRHYSDDVVKAFVAKAAVNGIDVFRIFDAMNDVRNLRVAIEAVKAAGKHAQGTIAYTTSPVHTIDAFVAQAKQMEAMGCDSVAIKDMAGLLTPYATGELVRALKAEQSLPVFIHSHDTAGLAAMCQLKAIENGADHIDTAISSFASGTSHPGTESMVAALKGTEFDTGLNLELLQEIGLYFYAVRKKYHQFESEFTAVDTRVQVNQVPGGMISNLANQLKEQGALNRMGEVLAEIPRVREDLGFPPLVTPTSQIVGTQAFFNVLAGERYKTITNEVKLYLQGGYGKAPGTVNEKLRRQAIGSEEVIDVRPADLLKPEMTKLRADIGALAKSEEDVLTFAMFPDIGRKFLEERAAGTLTPEVLLPIPEAGKVASAGGEGVPTEFVIDVHGETYRVDITGVGVKAEGKRHFYLSIDGMPEEVVFEPLNEFVGGGSSKRKQASAPGHVSTTMPGNIVDVLVKEGDTVKAGQAVLITEAMKMETEVQAAIAGKVTAIHVAKGDRVNPGEILIEIEG

SEQ ID NO: 6 - protein, 481 aa, Pseudomonas fluorescens
MVPPAQGNLQVITKILIANRGEIAVRIVRACAEMGIRSVAIYSDADRHALHVKRADEAHSIGAEPLAGYLNPRKLVNLAVETGCDALHPGYGFLSENAELADICAERGIKFIGPSAEVIRRMGDKTEARRSMIKAGVPVTPGTEGNVSGIEEALSEGDRIGYPVMLKATSGGGGRGIRRCNSREELEQNFPRVISEATKAFGSAEVFLEKCIVNPKHIEAQILGDSFGNVVHLFERDCSIQRRNQKLIEIAPSPQLTPEQRAYIGDLSVRAAKAVGYENAGTVEFLLAEGEVYFMEMNTRVQVEHTITEEITGIDIVREQIRIASGLPLSVKQEDIQHRGFALQFRINAEDPKNNFLPSFGKITRYYAPGGPGVRTDTAIYTGYTIPPFYDSMCLKLVVWALTWEEAMDRGLRALDDMRLQGVKTTAAYYQEILRNPEFRSGQFNTSFVESHPELTNYSIKRKPEELALAIAAAIAAHAGL

SEQ ID NO: 7 - protein, 1140 aa, Corynebacterium glutamicum
MSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDRLKQLGPAAFARDLREQDALAVTDTTFRDAHQSLLATRVRSFALKPAAEAVAKLTPELLSVEAWGGATYDVAMRFLFEDPWDRLDELREAMPNVNIQMLLRGRNTVGYTPYPDSVCRAFVKEAASSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASAPLSGTTSQPSLSAIVAAFAHTRRDTGLSLEAVSDLEPYWEAVRGLYLPFESGTPGPTGRVYRHEIPGGQLSNLRAQATALGLADRFELIEDNYAAVNEMLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIDRVVVPAATKVEGGDLIVVVS

SEQ ID NO: 8 - protein, 1152 aa, Sinorhizobium meliloti
MSISKILVANRSEIAIRVFRAANELGLKTVAIWAEEDKLALHRFKADESYQVGRGPHLPRDLGPIMSYLSIDEVIRVAKLSGADAIHPGYGLLSESPEFAEACAANGITFIGPKPETMRQLGNKVAARNLAISIGVPVVPATEPLPDDPEEIKRLAEEIGYPVMLKASWGGGGRGMRAIRDPKDLIREVTEAKREAKAAFGKDEVYLEKLVERARHVESQILGDTHGNVVHLFERDCSIQRRNQKVVERAPAPYLNDAQRQELADYSLKIARATNYIGAGTVEYLMDSDTGKFYFIEVNPRIQVEHTVTEVVTGIDIVKAQIHILDGFAIGAPESGVPRQEDIRLNGHALQCRITTEDPEQNFIPDYGRITAYRGATGFGIRLDGGTAYSGAVITRYYDPLLEKVTAWAPNPGEAIQRMIRALREFRIRGVATNLTFLEAIISHPKFHDNSYTTRFIDTTPELFQQVKRQDRATKLLTYLADVTVNGHPEVKGRPKPSDDIAAPVVPFTGGDVKPGTKQRLDQLGPKKFAEWVKAQPEVLITDTTMRDGHQSLLATRMRTYDIARIAGTYARALPNLFSLECWGGATFDVSMRFLTEDPWERLAMVREGAPNLLLQMLLRGANGVGYKNYPDNVVKYFVRQAAKGGIDVFRVFDCLNWVENMRVAMDAVAEEDRICEAAICYTGDILNSARPKYDLKYYTALAAELEKAGAHMIAVKDMAGLLKPAAARVLFKALKEATGLPIHFHTHDTSGIAAATVLAAVESGVDVVDAAMDALSGNTSQPCLGSIVEALSGSERDPGLDPEWIRRISFYWEAVRHQYAAFESDLKGPASEVYLHEMPGGQFTNLKEQARSLGLETRWHEVAQAYADANRMFGDIVKVTPSSKVVGDMALMMVSQDLTVADVENPGKDIAFPESVVSMLKGDLGQPPGGWPEALQKKALKGEEPYDARPGSLLEDADLDAERKGIEEKLGREVTDFEFASYLMYPKVFTDYAVACETYGPVSVLPTPAYFYGMAPGEELFADIEKGKTLVILNQAQGEIDEKGMVKMFFEMNGQPRSIKVPDRNRGASAAVRRKAEAGNAAHLGAPMPGVISTVAVASGQSVKAGDVLLSIEAMKMETALHAEKDGVISEVLVRAGDQIDAKDLLVVFGG

SEQ ID NO: 9 - DNA, 2652 bp, Escherichia coli
atgaacgaacaatattccgcattgcgtagtaatgtcagtatgctcggcaaagtgctgggagaaaccatcaaggatgcgttgggagaacacattcttgaacgcgtagaaactatccgtaagttgtcgaaatcttcacgcgctggcaatgatgctaaccgccaggagttgctcaccaccttacaaaatttgtcgaacgacgagctgctgcccgttgcgcgtgcgtttagtcagttcctgaacctggccaacaccgccgagcaataccacagcatttcgccgaaaggcgaagctgccagcaacccggaagtgatcgcccgcaccctgcgtaaactgaaaaaccagccggaactgagcgaagacaccatcaaaaaagcagtggaatcgctgtcgctggaactggtcctcacggctcacccaaccgaaattacccgtcgtacactgatccacaaaatggtggaagtgaacgcctgtttaaaacagctcgataacaaagatatcgctgactacgaacacaaccagctgatgcgtcgcctgcgccagttgatcgcccagtcatggcataccgatgaaatccgtaagctgcgtccaagcccggtagatgaagccaaatggggctttgccgtagtggaaaacagcctgtggcaaggcgtaccaaattacctgcgcgaactgaacgaacaactggaagagaacctcggctacaaactgcccgtcgaatttgttccggtccgttttacttcgtggatgggcggcgaccgcgacggcaacccgaacgtcactgccgatatcacccgccacgtcctgctactcagccgctggaaagccaccgatttgttcctgaaagatattcaggtgctggtttctgaactgtcgatggttgaagcgacccctgaactgctggcgctggttggcgaagaaggtgccgcagaaccgtatcgctatctgatgaaaaacctgcgttctcgcctgatggcgacacaggcatggctggaagcgcgcctgaaaggcgaagaactgccaaaaccagaaggcctgctgacacaaaacgaagaactgtgggaaccgctctacgcttgctaccagtcacttcaggcgtgtggcatgggtattatcgccaacggcgatctgctcgacaccctgcgccgcgtgaaatgtttcggcgtaccgctggtccgtattgatatccgtcaggagagcacgcgtcataccgaagcgctgggcgagctgacccgctacctcggtatcggcgactacgaaagctggtcagaggccgacaaacaggcgttcctgatccgcgaactgaactccaaacgtccgcttctgccgcgcaactggcaaccaagcgccgaaacgcgcgaagtgctcgatacctgccaggtgattgccgaagcaccgcaaggctccattgccgcctacgtgatctcgatggcgaaaacgccgtccgacgtactggctgtccacctgctgctgaaagaagcgggtatcgggtttgcgatgccggttgctccgctgtttgaaaccctcgatgatctgaacaacgccaacgatgtcatgacccagctgctcaatattgactggtatcgtggcctgattcagggcaaacagatggtgatgattggctattccgactcagcaaaagatgcgggagtgatggcagcttcctgggcgcaatatcaggcacaggatgcattaatcaaaacctgcgaaaaagcgggtattgagctgacgttgttccacggtcgcggcggttccattggtcgcggcggcgcacctgctcatgcggcgctgctgtcacaaccgccaggaagcctgaaaggcggcctgcgcgtaaccgaacagggcgagatgatccgctttaaatatggtctgccagaaatcaccgtcagcagcctgtcgctttataccggggcgattctggaagccaacctgctgccaccgccggagccgaaagagagctggcgtcgcattatggatgaactgtcagtcatctcctgcgatgtctaccgcggctacgtacgtgaaaacaaagattttgtgccttacttccgctccgctacgccggaacaagaactgggcaaactgccgttgggttcacgtccggcgaaacgtcgcccaaccggcggcgtcgagtcactacgcgccattccgtggatcttcgcctggacgcaaaaccgtctgatgctccccgcctggctgggtgcaggtacggcgctgcaaaaagtggtcgaagacggcaaacagagcgagctggaggctatgtgccgcgattggccattcttctcgacgcgtctcggcatgctggagatggtcttcgccaaagcagacctgtggctggcggaatactatgaccaacgcctggtagacaaagcactgtggccgttaggtaaagagttacgcaacctgcaagaagaagacatcaaagtggtgctggcgattgccaacgattcccatctgatggccgatctgccgtggattgcagagtctattcagctacggaatatttacaccgacccgctgaacgtattgcaggccgagttgctgcaccgctcccgccaggcagaaaaagaaggccaggaaccggatcctcgcgtcgaacaagcgttaatggtcactattgccgggattgcggcaggtatgcgtaataccggctaa

SEQ ID NO: 10 - protein, 883 aa, Escherichia coli
MNEQYSALRSNVSMLGKVLGETIKDALGEHILERVETIRKLSKSSRAGNDANRQELLTTLQNLSNDELLPVARAFSQFLNLANTAEQYHSISPKGEAASNPEVIARTLRKLKNQPELSEDTIKKAVESLSLELVLTAHPTEITRRTLIHKMVEVNACLKQLDNKDIADYEHNQLMRRLRQLIAQSWHTDEIRKLRPSPVDEAKWGFAVVENSLWQGVPNYLRELNEQLEENLGYKLPVEFVPVRFTSWMGGDRDGNPNVTADITRHVLLLSRWKATDLFLKDIQVLVSELSMVEATPELLALVGEEGAAEPYRYLMKNLRSRLMATQAWLEARLKGEELPKPEGLLTQNEELWEPLYACYQSLQACGMGIIANGDLLDTLRRVKCFGVPLVRIDIRQESTRHTEALGELTRYLGIGDYESWSEADKQAFLIRELNSKRPLLPRNWQPSAETREVLDTCQVIAEAPQGSIAAYVISMAKTPSDVLAVHLLLKEAGIGFAMPVAPLFETLDDLNNANDVMTQLLNIDWYRGLIQGKQMVMIGYSDSAKDAGVMAASWAQYQAQDALIKTCEKAGIELTLFHGRGGSIGRGGAPAHAALLSQPPGSLKGGLRVTEQGEMIRFKYGLPEITVSSLSLYTGAILEANLLPPPEPKESWRRIMDELSVISCDVYRGYVRENKDFVPYFRSATPEQELGKLPLGSRPAKRRPTGGVESLRAIPWIFAWTQNRLMLPAWLGAGTALQKVVEDGKQSELEAMCRDWPFFSTRLGMLEMVFAKADLWLAEYYDQRLVDKALWPLGKELRNLQEEDIKVVLAIANDSHLMADLPWIAESIQLRNIYTDPLNVLQAELLHRSRQAEKEGQEPDPRVEQALMVTIAGIAAGMRNTG

SEQ ID NO: 11 - protein, 483 aa, Methanobacterium thermoautotrophicum
MKVPRCMSTQHPDNVNPPFFAEEPELGGEDEIREAYYVFSHLGCDEQMWDCEGKEVDNYVVKKLLTKYQAFFRDHVLGEDLRLTLRVPNPTVERAEAKILLETLESIPRSYDTASLFYGMDAAPVFEVILPMTSSSSCLNRIHSYYLDFVKGKERLQLADGVTVKEWIGEFRPDEINVIPLFEDHEGMLNAAKITGEYLDGKDIQEQRVFLARSDPAMNYGMISATLLNRIALSDFRDLEEESGVKLYPIIGMGSAPFRGNLRPDNVEDVTWEYRGAYTFTVQSSFKYDHEPSDVIRGIKKLRSVKPGRAAEIERESVLEIISAYCREYRRQVMDLVDIINRVARYVPGRRKRKLHIGLFGYSRSMGNVSLPRAITFTAALYSLGVPPELLGFNALSSGDLEFIEEVYPGLGRDLHDAARYANPESPFLSPEVKSSFEEYLEPEYDEGHMKTTEEIIRALRINRTANLQELILEAASQRKFLG

SEQ ID NO: 12 - protein, 537 aa, Clostridium perfringens
MKIPCSMMTQHPDNVETYISIQQEPAEAIKGLTPQDKGGLGIEEVMIDFEGKLTPYHQTSQIALGLISNGIIPGKDVRVTPRIPNANKESVFRQLMSIMSIIETNVQSKELTGTPAISEVVVPMIETGKEISEFQDRVNSVVDMGNKNYKTKLDLNSVRIIPLVEDVPALANIDRILDEHYEIEKSKGHILKDLRIMIARSDTAMSYGLISGVLSVLMAVDGAYKWGEKHGVTISPILGCGSLPFRGHFSEENIDEILATYSGIKTFTFQSALRYDHGEEATKHAVRELKEKIAQSKPRNFSEEDKDLMKEFIGICSKHYLQTFLKVIDTVSFVSDFIPKNRDRLTKAKTGLEYNREVANLDNVADLVKDEVLKQEILSIDNSKEYAVPRAISFTGAMYTLGMPPELMGMGRALNEIKTKYGQEGIDKLLEIYPILRKDLAFAARFANGGVSKKIIDEEARQEYKEDMKYVNEILNLGLDYDFLNENEFYHTLLKTTKPIIMHLMGLEENVMRNSTEELKILNEWIVRMGKVRGSIG

SEQ ID NO: 13 - DNA, 1260 bp, Issatchenkia orientalis
atgtccagaggcttctttactgagaacattacgcaattgccaccagaccctttgtttggtcttaaggccaggttcagcaatgactcacgtgaaaacaaggtcgatttaggtattggggcatatagggacgacaacggtaagccatggatcttaccatctgtcaggttggccgaaaacttgattcagaactccccagactacaaccatgagtacctaccaatcggtggacttgctgatttcacttctgctgcggcaagagttgtatttggaggcgattctaaagccatttcgcaaaaccgtcttgtctccatccagagtttgtcaggtacaggtgccttacatgttgctggtctatttatcaagcgccaatacaagtctcttgatggcacttccgaagaccctctaatatatctatcggaacctacatgggccaaccacgttcaaatctttgaagttattggtctcaagcctgtattctatccatattggcatgccgcaagcaagaccttggatctgaagggctacttaaaggcaataaacgatgctccagaagggtcggtttttgtattgcatgcaacggctcataaccctactggtttggatccaacacaagaacaatggatggagattttggccgctataagtgccaaaaagcatctgccattatttgattgtgcatatcagggtttcacctccgggtctctagatagagatgcttgggctgttcgagaagctgtcaacaatgacaagtacgaattcccgggaattattgtctgtcaatcgtttgcgaaaaatgttggcatgtatggtgaacggattggtgcagttcatattgttctacctgaatcagacgcttccctaaacagcgccatcttctcccaattgcaaaagacaatcagatcggagatttccaatccaccaggatacggtgcaaagattgtgtctaaagttttgaacactccggaactttacaaacagtgggagcaagatttgatcaccatgtcttcgagaatcactgcaatgagaaaggagctagtaaatgagctcgagcgtcttggaacccctggcacttggagacacatcaccgagcaacagggtatgttttcctttactggtttgaacccggagcaggttgccaagctagagaaggagcatggtgtttatcttgttcgtagtggacgtgcaagtattgcaggcctcaacatgggaaacgtcaagtatgttgccaaggccattgactctgtcgtgagagacctttag

SEQ ID NO: 14 - protein, 419 aa, Issatchenkia orientalis
MSRGFFTENITQLPPDPLFGLKARFSNDSRENKVDLGIGAYRDDNGKPWILPSVRLAENLIQNSPDYNHEYLPIGGLADFTSAAARVVFGGDSKAISQNRLVSIQSLSGTGALHVAGLFIKRQYKSLDGTSEDPLIYLSEPTWANHVQIFEVIGLKPVFYPYWHAASKTLDLKGYLKAINDAPEGSVFVLHATAHNPTGLDPTQEQWMEILAAISAKKHLPLFDCAYQGFTSGSLDRDAWAVREAVNNDKYEFPGIIVCQSFAKNVGMYGERIGAVHIVLPESDASLNSAIFSQLQKTIRSEISNPPGYGAKIVSKVLNTPELYKQWEQDLITMSSRITAMRKELVNELERLGTPGTWRHITEQQGMFSFTGLNPEQVAKLEKEHGVYLVRSGRASIAGLNMGNVKYVAKAIDSVVRDL

SEQ ID NO: 15 - protein, 418 aa, Saccharomyces cerevisiae
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 16 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 17 - protein, 139 aa, Streptomyces avermitilis
MLRTMFKSKIHRATVTQADLHYVGSVTIDADLLDAADLLPGELVHIVDITNGARLETYVIEGERGSGVVGINGAAAHLVHPGDLVIIISYAQVSDAEARALRPRVVHVDRDNRVVALGADPAEPVPGSDQARSPQAVTA

SEQ ID NO: 18 - protein, 127 aa, Clostridium acetobutylicum
MHLNMLKSKIHRATVVQADLNYVGSITIDRNLMDKANILEYEKVEIANINNGARFETYVIAGEAGSGIICLNGAAARCAQAGDKVIIMCYCSLTPEEASEHRPKVVFVNDDNSISNVTEYEKHGTIG

SEQ ID NO: 19 - DNA, 1404 bp, Issatchenkia orientalis
atgtctattagtgaaaaatattttcctcaagaacctcaatctcctgaattgaaaactgcaattccaggtcctcaatcaaaggcaaagctcgaggaattatctgctgtctatgatacaaaggctgcatattttgttaccgactactacaaatctcttggtaactatattgtggatgcagatggcaacaagctactagattcttattgccaaatctcttctatcgcattgggttacaataatccagcattattaaaagtagcacattctgatgaaatgacagttgctttatgtaacagacctgctttggcatgttttccatccactgattactatgaaatactaaagaagggattgttgtccgttgctccaaagggattagataaggtttgtactgcacacacgggatctgatgccaatgaaatggcatttaaggctgcatttttgtttcaagcaagtaagaagagaggtgacaaaccatttaccagcgaagagctggaatctgtcatggagaacaagttgccaggcacctctgacatggttatcctgtcatttgaaaaagggttccatggtagattgtttggatctttatctaccactagatctaaagctattcacaaactggatattcctgcgtttgaatggccaaaggctccattccctcagttaaagtatcctctggatcaattccaagctgaaaacaaagcagaagaagaaagatgtttgaaggctttagaggaaattattgtcaactctcctgccaaaattgcagctgcaatcattgaaccggtccaatctgaaggtggtgataatcatgcttcaccagaattcttccaaggtattagagaaatcaccaaaaagcacggtgtcattcttattgttgatgaagttcaaacaggaggtggtgcttctggtaagatgtggttacatgaacactatggcattgtcccagacatcatgactttttctaaaaaaatgcaaaatgcaggtttctttttcagtgaagcaggtcttgctggggaccaaccattcagacaattcaatacctggtgcggtgatccatcaaaagctctaattgcaagaaccataattgaagaaattaaagataagaacctattgactagtgttaccgaaacaggtgactacctatattcaaagctcgaagcaatttcagcaaagtatgacaaaatgatcaacttgagaggtaagggaagaggtttctttattgcatttgatgccccaacaccggagttaagaaacaaatttattgctgaatgtaagaaattaggtttaaacattggtggatgcggtgaacaaggtgttagattgagacctgcattagtttttgaaaagaagcatgctgatatcttagcctccattattgatcaagctttttccaaaatttaa

SEQ ID NO: 20 - protein, 467 aa, Issatchenkia orientalis
MSISEKYFPQEPQSPELKTAIPGPQSKAKLEELSAVYDTKAAYFVTDYYKSLGNYIVDADGNKLLDSYCQISSIALGYNNPALLKVAHSDEMTVALCNRPALACFPSTDYYEILKKGLLSVAPKGLDKVCTAHTGSDANEMAFKAAFLFQASKKRGDKPFTSEELESVMENKLPGTSDMVILSFEKGFHGRLFGSLSTTRSKAIHKLDIPAFEWPKAPFPQLKYPLDQFQAENKAEEERCLKALEEIIVNSPAKIAAAIIEPVQSEGGDNHASPEFFQGIREITKKHGVILIVDEVQTGGGASGKMWLHEHYGIVPDIMTFSKKMQNAGFFFSEAGLAGDQPFRQFNTWCGDPSKALIARTIIEEIKDKNLLTSVTETGDYLYSKLEAISAKYDKMINLRGKGRGFFIAFDAPTPELRNKFIAECKKLGLNIGGCGEQGVRLRPALVFEKKHADILASIIDQAFSKI

SEQ ID NO: 21 - protein, 475 aa, Saccharomyces kluyveri
MPSYSVAELYYPDEPTEPKISTSSYPGPKAKQELEKLSNVFDTRAAYLLADYYKSRGNYIVDQDGNVLLDVYAQISSIALGYNNPEILKVAKSDAMSVALANRPALACFPSNDYGQLLEDGLLKAAPQGQDKIWTALSGSDANETAFKACFMYQAAKKRNGRSFSTEELESVMDNQLPGTSEMVICSFEKGFHGRLFGSLSTTRSKPIHKLDIPAFNWPKAPFPDLKYPLEENKEANKAEESSCIEKFSQIVQEWQGKIAAVIIEPIQSEGGDNHASSDFFQKLREITIENGILMIVDEVQTGVGATGKMWAHEHWNLSNPPDLVTFSKKFQAAGFYYHDPKLQPDQPFRQFNTWCGDPSKALIAKVIYEEIVKHDLVTRTAEVGNYLFNRLEKLFEGKNYIQNLRGKGQGTYIAFDFGTSSERDSFLSRLRCNGANVAGCGDSAVRLRPSLTFEEKHADVLVSIFDKTLRQLYG

SEQ ID NO: 22 - protein, 451 aa, Streptomyces avermitilis
MTPQPNPQVGAAVKAADRAHVFHSWSAQELIDPLAVAGAEGSYFWDYDGRRYLDFTSGLVFTNIGYQHPKVVAAIQEQAASLTTFAPAFAVEARSEAARLIAERTPGDLDKIFFTNGGADAIEHAVRMARIHTGRPKVLSAYRSYHGGTQQAVNITGDPRRWASDSASAGVVHFWAPYLYRSRFYAETEQQECERALEHLETTIAFEGPGTIAAIVLETVPGTAGIMVPPPGYLAGVRELCDKYGIVFVLDEVMAGFGRTGEWFAADLFDVTPDLMTFAKGVNSGYVPLGGVAISGKIAETFGKRAYPGGLTYSGHPLACAAAVATINVMAEEGVVENAANLGARVIEPGLRELAERHPSVGEVRGVGMFWALELVKDRETREPLVPYNAAGEANAPMAAFGAAAKANGLWPFINMNRTHVVPPCNVTEAEAKEGLAALDAALSVADEYTV

SEQ ID NO: 23 - protein, 419 aa, Streptomyces avermitilis
MSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 24 - protein, 471 aa, Saccharomyces cerevisiae
MSICEQYYPEEPTKPTVKTESIPGPESQKQLKELGEVFDTRPAYFLADYEKSLGNYITDVDGNTYLDLYAQISSIALGYNNPALIKAAQSPEMIRALVDRPALGNFPSKDLDKILKQILKSAPKGQDHVWSGLSGADANELAFKAAFIYYRAKQRGYDADFSEKENLSVMDNDAPGAPHLAVLSFKRAFHGRLFASGSTTCSKPIHKLDFPAFHWPHAEYPSYQYPLDENSDANRKEDDHCLAIVEELIKTWSIPVAALIIEPIQSEGGDNHASKYFLQKLRDITLKYNVVYIIDEVQTGVGATGKLWCHEYADIQPPVDLVTFSKKFQSAGYFFHDPKFIPNKPYRQFNTWCGEPARMIIAGAIGQEISDKKLTEQCSRVGDYLFKKLEGLQKKYPENFQNLRGKGRGTFIAWDLPTGEKRDLLLKKLKLNGCNVGGCAVHAVRLRPSLTFEEKHADIFIEALAKSVNEL

SEQ ID NO: 25 - DNA, 813 bp, Issatchenkia orientalis
atgtttggtaatatttcccaaagacttgcaggcaagaacatcctaattacaggtgcgtccactggtatcggataccatacagcaaagtattttgcagaagctgcaaatggagacttgaagttggttttggctgcaagaagaaaggagaagctggaggcactaaaggcagacttgcttgccaagtatccatccatcaaagtccatattgagagtttggatgtctccaaaacggaaaccattgcacctttcttaaaaggtttacctgaggaattttcaattgtcgacgtgttggtcaacaatgcaggtaaggcgcttggtttggatccaattggctctgtcgatccaaaggacgtggatgaaatgttccagaccaatgttttgggtatgattcaattgacccagttggttgtacagcaaatgaaggagagaaactccggggacattgtccaactaggttcagtggctggtagaaacccatacccaggtggtggtatctactgtgcctccaaggccgcattgagatcttttacacatgtattgagagaggaattgattaataccaagattagagtgattgaaatcgagcctggaaatgttgcaactgaggaattttctttgaccagattcaaaggtgataagtccaaggccgaaaaggtctatgagggaaccgagccattgtatggtaccgatattgcagaattgattctatttgcagtttctagacctcaaaacactgttattgcagaaacacttgtttttgctagtaaccaagcttctgcttaccatattttcagaggatcattagataaatag

SEQ ID NO: 26 - protein, 270 aa, Issatchenkia orientalis
MFGNISQRLAGKNILITGASTGIGYHTAKYFAEAANGDLKLVLAARRKEKLEALKADLLAKYPSIKVHIESLDVSKTETIAPFLKGLPEEFSIVDVLVNNAGKALGLDPIGSVDPKDVDEMFQTNVLGMIQLTQLVVQQMKERNSGDIVQLGSVAGRNPYPGGGIYCASKAALRSFTHVLREELINTKIRVIEIEPGNVATEEFSLTRFKGDKSKAEKVYEGTEPLYGTDIAELILFAVSRPQNTVIAETLVFASNQASAYHIFRGSLDK

SEQ ID NO: 27 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 28 - protein, 298 aa, Alcaligenes faecalis
MSNTIAFIGLGHMGKPMALNLLKAGHSLNVFDLNAQAMQELQAAGAQVGESAVQIAQDAQMVFTMLPAGRHVRQVYEGENGLLQTVAPGTVLVDCSTIDAQTSQDLAAKASKLGLFMLDAPVSGGTGGAIAGTLTFMVGGEDQALEKARPYLDAMGKNIFHAGKAGAGQVAKICNNMLLGILMAGTAEALALGVAHGLDPAVLSTIMARSSGRNWATELYNPWPGVMPDVPASRDYQGGFATGLMLKDLGLAADAAVSQNSATPLGELARNLFALHAAQGQNAGLDFSSILNLYRQKH

SEQ ID NO: 29 - protein, 314 aa, Metallosphaera sedula
MTEKVSVVGAGVIGVGWATLFASKGYSVSLYTEKKETLDKGIEKLRNYVQVMKNNSQITEDVNTVISRVSPTTNLDEAVRGANFVIEAVIEDYDAKKKIFGYLDSVLDKEVILASSTSGLLITEVQKAMSKHPERAVIAHPWNPPHLLPLVEIVPGEKTSMEVVERTKSLMEKLDRIVVVLKKEIPGFIGNRLAFALFREAVYLVDEGVATVEDIDKVMTAAIGLRWAFMGPFLTYHLGGGEGGLEYFFNRGFGYGANEWMHTLAKYDKFPYTGVTKAIQQMKEYSFIKGKTFQEISKWRDEKLLKVYKLVWEK

SEQ ID NO: 30 - protein, 295 aa, Pseudomonas putida
MRIAFIGLGNMGAPMARNLIKAGHQLNLFDLNKAVLAELAELGGQISPSPKDAAANSELVITMLPAAAHVRSVYLNEDGVLAGIRPGTPTVDCSTIDPQTARDVSKAAAAKGVDMGDAPVSGGTGGAAAGTLTFMVGASTELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 31 - protein, 295 aa, Pseudomonas putida
MRIAFIGLGNMGAPMARNLIKAGHQLNLFDLNKTVLAELAELGGQISPSPKDAAASSELVITMLPAAAHVRSVYLNDDGVLAGIRPGTPTVDCSTIDPQTARDVSKAAAAKGVDMGDAPVSGGTGGAAAGTLTFMVGASAELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 32 - protein, 298 aa, Pseudomonas aeruginosa
MTDIAFLGLGNMGGPMAANLLKAGHRVNVFDLQPKAVLGLVEQGAQGADSALQCCEGAEVVISMLPAGQHVESLYLGDDGLLARVAGKPLLIDCSTIAPETARKVAEAAAAKGLTLLDAPVSGGVGGARAGTLSFIVGGPAEGFARARPVLENMGRNIFHAGDHGAGQVAKICNNMLLGILMAGTAEALALGVKNGLDPAVLSEVMKQSSGGNWALNLYNPWPGVMPQAPASNGYAGGFQVRLMNKDLGLALANAQAVQASTPLGALARNLFSLHAQADAEHEGLDFSSIQKLYRGKD

SEQ ID NO: 33 - protein, 382 aa, Ralstonia eutropha
MAFIYYLTHIHLDFGAVSLLKSECERIGIRRPLLVTDKGVVAAGVAQRAIDAMQGLQVAVFDETPSNPTEAMVRKAAAQYREAGCDGLVAVGGGSSIDLAKGIAILATHEGELTTYATIEGGSARITDKAAPLIAVPTTSGTGSEVARGAIIILDDGRKLGFHSWHLLPKSAVCDPELTLGLPAGLTAATGMDAIAHCIETFLAPAFNPPADGIALDGLERGWGHIERATRDGQDRDARLNMMSASMQGAMAFQKGLGCVHSLSHPLGGLKIDGRTGLHHGTLNAVVMPAVLRFNADAPTVVRDDRYARLRRAMHLPDGADIAQAVHDMTVRLGLPTGLRQMGVTEDMFDKVIAGALVDHCHKTNPKEASAADYRRMLEQSM

SEQ ID NO: 34 - protein, 371 aa, Clostridium kluyveri
MKLLKLAPDVYKFDTAEEFMKYFKVGKGDFILTNEFLYKPFLEKFNDGADAVFQEKYGLGEPSDEMINNIIKDIGDKQYNRIIAVGGGSVIDIAKILSLKYTDDSLDLFEGKVPLVKNKELIIVPTTCGTGSEVTNVSVAELKRRHTKKGIASDELYATYAVLVPEFIKGLPYKFFVTSSVDALIHATEAYVSPNANPYTDMFSVKAMELILNGYMQMVEKGNDYRVEIIEDFVIGSNYAGIAFGNAGVGAVHALSYPIGGNYHVPHGEANYLFFTEIFKTYYEKNPNGKIKDVNKLLAGILKCDESEAYDSLSQLLDKLLSRKPLREYGMKEEEIETFADSVIEGQQRLLVNNYEPFSREDIVNTYKKLY

SEQ ID NO: 35 - protein, 538 aa, Mannheimia succiniciproducens
MTDLNQLTQELGALGIHDVQEVVYNPSYELLFAEETKPGLEGYEKGTVTNQGAVAVNTGIFTGRSPKDKYIVLDDKTKDTVWWTSEKVKNDNKPMSQDTWNSLKGLVADQLSGKRLFVVDAFCGANKDTRLAVRVVTEVAWQAHFVTNMFIRPSAEELKGFKPDFVVMNGAKCTNPNWKEQGLNSENFVAFNITEGVQLIGGTWYGGEMKKGMFSMMNYFLPLRGIASMHCSANVGKDGDTAIFFGLSGTGKTTLSTDPKRQLIGDDEHGWDDEGVFNFEGGCYAKTINLSAENEPDIYGAIKRDALLENVVVLDNGDVDYADGSKTENTRVSYPIYHIQNIVKPVSKAGPATKVIFLSADAFGVLPPVSKLTPEQTKYYFLSGFTAKLAGTERGITEPTPTFSACFGAAFLSLHPTQYAEVLVKRMQESGAEAYLVNTGWNGTGKRISIKDTRGIIDAILDGSIDKAEMGSLPIFDFSIPKALPGVNPAILDPRDTYADKAQWEEKAQDLAGRFVKNFEKYTGTAEGQALVAAGPKA

SEQ ID NO: 36 - protein, 532 aa, Anaerobiospirillum succiniciproducens
MSLSESLAKYGITGATNIVHNPSHEELFAAETQASLEGFEKGTVTEMGAVNVMTGVYTGRSPKDKFIVKNEASKEIWWTSDEFKNDNKPVTEEAWAQLKALAGKELSNKPLYVVDLFCGANENTRLKIRFVMEVAWQAHFVTNMFIRPTEEELKGFEPDFVVLNASKAKVENFKELGLNSETAVVFNLAEKMQIILNTWYGGEMKKGMFSMMNFYLPLQGIAAMHCSANTDLEGKNTAIFFGLSGTGKTTLSTDPKRLLIGDDEHGWDDDGVFNFEGGCYAKVINLSKENEPDIWGAIKRNALLENVTVDANGKVDFADKSVTENTRVSYPIFHIKNIVKPVSKAPAAKRVIFLSADAFGVLPPVSILSKEQTKYYFLSGFTAKLAGTERGITEPTPTFSSCFGAAFLTLPPTKYAEVLVKRMEASGAKAYLVNTGWNGTGKRISIKDTRGIIDAILDGSIDTANTATIPYFNFTVPTELKGVDTKILDPRNTYADASEWEVKAKDLAERFQKNFKKFESLGGDLVKAGPQL

SEQ ID NO: 37 - protein, 538 aa, Actinobacillus succinogenes
MTDLNKLVKELNDLGLTDVKEIVYNPSYEQLFEEETKPGLEGFDKGTLTTLGAVAVDTGIFTGRSPKDKYIVCDETTKDTVWWNSEAAKNDNKPMTQETWKSLRELVAKQLSGKRLFVVEGYCGASEKHRIGVRMVTEVAWQAHFVKNMFIRPTDEELKNFKADFTVLNGAKCTNPNWKEQGLNSENFVAFNITEGIQLIGGTWYGGEMKKGMFSMMNYFLPLKGVASMHCSANVGKDGDVAIFFGLSGTGKTTLSTDPKRQLIGDDEHGWDESGVFNFEGGCYAKTINLSQENEPDIYGAIRRDALLENVVVRADGSVDFDDGSKTENTRVSYPIYHIDNIVRPVSKAGHATKVIFLTADAFGVLPPVSKLTPEQTEYYFLSGFTAKLAGTERGVTEPTPTFSACFGAAFLSLHPIQYADVLVERMKASGAEAYLVNTGWNGTGKRISIKDTRGIIDAILDGSIEKAEMGELPIFNLAIPKALPGVDPAILDPRDTYADKAQWQVKAEDLANRFVKNFVKYTANPEAAKLVGAGPKA

SEQ ID NO: 38 - protein, 618 aa, Ralstonia eutropha
MNHPSMQGTTALNVPAWVRNQKLVAWVAEIAALTKPERIHWCDGSQEEYDRLCEQMVAAGTLKRLNPAKRKNSYLALSDPSDVARVEDRTFICSQKKEDAGPTNNWVAPAEMRTTLNGLFDGCMRGRTLYVVPFSMGPLGSPIAHIGVELSDSPYVAVNMRIMTRMGKAVYDVLGTDGDFVPCVHTVGKPLAAGEKDVPWPCNPTKYIVHFPESREIWSFGSGYGGNALLGKKCFALRIASTMGRDEGWLAEHMLILGVTSPEGKKFHVAAAFPSACGKTNFAMLIPPKGFEGWKVTTIGDDIAWIKPGKDGRLYAINPEAGYFGVAPGTSEKTNFNAMATLKENVIFTNVALTDDGDVWWEGMTKEAPAHLTDWQGKDWTPEIAKATGAKAAHPNARFTAPASQCPSIDENWDNPAGVPIDAFIFGGRRSTTVPLVTEARNWTEGVYMAATMGSETTAAAAGQQGVVRRDPFAMLPFCGYNMSDYFGHWLALGQKLEAAGAKLPKIYCVNWFRKDADGNFVWPGFGENMRVLSWMIDRVEGKGEGAEHVFGTSPRYEDLNWSGVEFSVAQFTQVTSIDADAWKQELALHDELFTQLKHNLPQALAEARAALGKRLEG

SEQ ID NO: 39 - protein, 540 aa, Escherichia coli
MRVNNGLTPQELEAYGISDVHDIVYNPSYDLLYQEELDPSLTGYERGVLTNLGAVAVDTGIFTGRSPKDKYIVRDDTTRDTFWWADKGKGKNDNKPLSPETWQHLKGLVTRQLSGKRLFVVDAFCGANPDTRLSVRFITEVAWQAHFVKNMFIRPSDEELAGFKPDFIVMNGAKCTNPQWKEQGLNSENFVAFNLTERMQLIGGTWYGGEMKKGMFSMMNYLLPLKGIASMHCSANVGEKGDVAVFFGLSGTGKTTLSTDPKRRLIGDDEHGWDDDGVFNFEGGCYAKTIKLSKEAEPEIYNAIRRDALLENVTVREDGTIDFDDGSKTENTRVSYPIYHIDNIVKPVSKAGHATKVIFLTADAFGVLPPVSRLTADQTQYHFLSGFTAKLAGTERGITEPTPTFSACFGAAFLSLHPTQYAEVLVKRMQAAGAQAYLVNTGWNGTGKRISIKDTRAIIDAILNGSLDNAETFTLPMFNLAIPTELPGVDTKILDPRNTYASPEQWQEKAETLAKLFIDNFDKYTDTPAGAALVAAGPKL

SEQ ID NO: 40 - protein, 236 aa, Lactococcus lactis
MSEITQLFQYNTLGALMAGLYEGTMTIGELLKHGDLGIGTLDSIDGELIVLDGKAYQAKGDKTIVELTDDIKVPYAAVVPHQAEVVFKQKFTVSDKELEDRIESYFDGQNLFRSIKITGKFPKMHVRMIPRAKSGTKFVEVSQNQPEYTEENIKGTIVGIWTPEMFHGVSVAGYHLHFISEDFTFGGHVLDFIIDNGTVEIGAIDQLNQSFPVQDRKFLFADLDIEALKKDIDVAE

SEQ ID NO: 41 - protein, 239 aa, Streptococcus thermophilus
MSEAIKLFQYNTLGALMAGLYGGTLTVGELLEHGDLGLGTLDSIDGELIVLDGKAYQAKGSEGKVEVVEVSPDEKVPYAAVVPHQAEVIFRQRYEMTDKELEDRIESYYDGVNLFRSIKIKGHFKHMHVRMIPKSNADIKFADVATRQPEYEVDDISGTIVGIWTPEMFHGVSVAGYHLHFISDDLTFGGHVMDFVIENGIIEVGPVDQLDQRFPVQDRQYLFAKFNVDEMRKDITKAE

SEQ ID NO: 42 - protein, 285 aa, Brevibacillus brevis
MKKNIITSITSLALVAGLSLTAFAATTATVPAPPAKQESKPAVAANPAPKNVLFQYSTINALMLGQFEGDLTLKDLKLRGDMGLGTINDLDGEMIQMGTKFYQIDSTGKLSELPESVKTPFAVTTHFEPKEKTTLTNVQDYNQLTKMLEEKFENKNVFYAVKLTGTFKMVKARTVPKQTRPYPQLTEVTKKQSEFEFKNVKGTLIGFYTPNYAAALNVPGFHLHFITEDKTSGGHVLNLQFDNANLEISPIHEFDVQLPHTDDFAHSDLTQVTTSQVHQAESERK

SEQ ID NO: 43 - protein, 259 aa, Enterobacter aerogenes
MMMHSSACDCEASLCETLRGFSAQHPDSVIYQTSLMSALLSGVYVGETTIADLLAHGDFGLGTFNELDGEMIAFSSQVYQLRADGSARAAKPEQKTPFAVMTWFQPQYRKTFNGPVSRQQIHDVIDQQIPSDNLFCVRIDGNFRHAHTRTVPRQTPPYRAMTDVLDDQPVFRFNQREGVLVGFRTPQHMQGINVAGYHEHFITDDRQGGGHLLDYQLESGVLTFGEIHKLMIDLPADSAFLQANLHPSNLDAAIRAVEN

SEQ ID NO: 44 - protein, 1231 aa, Mycobacterium tuberculosis
MANISSPFGQNEWLVEEMYRKFRDDPSSVDPSWHEFLVDYSPEPTSQPAAEPTRVTSPLVAERAAAAAPQAPPKPADTAAAGNGVVAALAAKTAVPPPAEGDEVAVLRGAAAAVVKNMSASLEVPTATSVRAVPAKLLIDNRIVINNQLKRTRGGKISFTHLLGYALVQAVKKFPNMNRHYTEVDGKPTAVTPAHTNLGLAIDLQGKDGKRSLVVAGIKRCETMRFAQFVTAYEDIVRRARDGKLTTEDFAGVTISLTNPGTIGTVHSVPRLMPGQGAIIGVGAMEYPAEFQGASEERIAELGIGKLITLTSTYDHRIIQGAESGDFLRTIHELLLSDGFWDEVFRELSIPYLPVRWSTDNPDSIVDKNARVMNLIAAYRNRGHLMADTDPLRLDKARFRSHPDLEVLTHGLTLWDLDRVFKVDGFAGAQYKKLRDVLGLLRDAYCRHIGVEYAHILDPEQKEWLEQRVETKHVKPTVAQQKYILSKLNAAEAFETFLQTKYVGQKRFSLEGAESVIPMMDAAIDQCAEHGLDEVVIGMPHRGRLNVLANIVGKPYSQIFTEFEGNLNPSQAHGSGDVKYHLGATGLYLQMFGDNDIQVSLTANPSHLEAVDPVLEGLVRAKQDLLDHGSIDSDGQRAFSVVPLMLHGDAAFAGQGVVAETLNLANLPGYRVGGTIHIIVNNQIGFTTAPEYSRSSEYCTDVAKMIGAPIFHVNGDDPEACVWVARLAVDFRQRFKKDVVIDMLCYRRRGHNEGDDPSMTNPYVYDVVDTKRGARKSYTEALIGRGDISMKEAEDALRDYQGQLERVFNEVRELEKHGVQPSESVESDQMIPAGLATAVDKSLLARIGDAFLALPNGFTAHPRVQPVLEKRREMAYEGKIDWAFGELLALGSLVAEGKLVRLSGQDSRRGTFSQRHSVLIDRHTGEEFTPLQLLATNSDGSPTGGKFLVYDSPLSEYAAVGFEYGYTVGNPDAVVLWEAQFGDFVNGAQSIIDEFISSGEAKWGQLSNVVLLLPHGHEGQGPDHTSARIERFLQLWAEGSMTIAMPSTPSNYFHLLRRHALDGIQRPLIVFTPKSMLRHKAAVSEIKDFTEIKFRSVLEEPTYEDGIGDRNKVSRILLTSGKLYYELAARKAKDNRNDLAIVRLEQLAPLPRRRLRETLDRYENVKEFFWVQEEPANQGAWPRFGLELPELLPDKLAGIKRISRRAMSAPSSGSSKVHAVEQQEILDEAFG

SEQ ID NO: 45 - protein, 985 aa, Bradyrhizobium japonicum
MSRQDANAAFALSSFLQGTNATYIDEIYARYEKDPSSVDAEWQEFFKSLKDQPDDVRRNAEGPSWERANWPLTPQDDLTSALDGNWAEVEKAVGGKIAAKAQAKGADISSADLLQATRDSVRALMLIRSYRMRGHFHAKLDPLGIEAPRNREELDPRTYGFSEADFDRKIFLDHVLGLEYGTLREITAICERTYCQTLGVEFMHISNAAQKAWIQERIEGPDKEISFTREGRRAILTKLVEAEGFEKFCDTKFTGTKRFGLDGAESLIPALEQIIKRGGNLGVKEIVLGMPHRGRLNVLTQVMGKAHRALFHEFKGGSANPDAVEGSGDVKYHLGASSDREFDGNRIHLSLTANPSHLEIVDPVVLGKVRAKQDQHGDPPDMRISVMPLLMHGDAAFAGQGVVAECFGLSDLKGYRTGGSVHFIVNNQIGFTTYPRYSRSSPYPSDVAKMIDAPIFHVNGDDPEAVVFAAKVATEFRQKFHKPVVIDMFCYRRHGHNEGDEPAFTQPVMYKKIAAHPSTLELYARRLISEGVMTEGEVDKAKADWRARLDAEFEAGTSYKPNKADWLDGKWAGFKIADQEEDARRGVTGVDITALKDIGRKITKVPDGFRVHRTIQRFLENRSKAIDSGAGIDWATGEALAFCSLLNENHHVRLSGQDSERGTFSQRHSVLIDQEDESRYTPFNHLGHEQGHYEVINSLLSEEAVLGFEYGYSLAEPNTLTLWEAQFGDFANGAQVVFDQFISSGERKWLRMSGLVCLLPHGYEGQGPEHSSARLERYLQMCAEDNMQVVYPTTPANYFHVLRRQLHREIRKPLILMTPKSLLRHKRAVSRLEELAKGTTFHRILYDDAQMLPTDAIKLVPDEKIRRIVLCSGKVYYDLYEEREKRGIDDIYLMRVEQLYPVPLKALVAELSRFKKAEVVWCQEEPRNMGAWHFIEPYLEWVLNQVNGVSRRPRYVGRAASAATATGLMSKHQAQLKAFLDEALS

SEQ ID NO: 46 - protein, 995 aa, Rhizobium loti
MARQDQTNDQFSLTSFLYGGNADYIDALYAAYEDDPASVNPEWQEFFAGLKDDAGDVRRNAKGASWAKPSWPLQANGELVSALDGNWGIVEKHLEKKVKDKAVTNGVVLSDADVHQATRDSVRAIMMIRAYRMRGHLHANLDPLGIAKPLEDYNELSPENYGFTAADYDRPIFLDNVLGLEFGTIRQMLEILTRTYCSTLGVEFMHISDPEEKAWIQARIEGADKEISFTNTGKKAILQKLVEAEGFEQFIDVKYKGTKRFGLDGGEALIPALEQIVKRGGQLGMKEIVLGMAHRGRLNVLSQVMAKPHRAIFHEFKGGSAAPDEVEGSGDVKYHLGASSDREFDGNKVHLSLTANPSHLEIVDPVVMGKARAKQDYLFGRGREEIVPLEERAKVLPLLLHGDAAFAGQGVIAEILGLSGLRGHRVAGTLHFIINNQIGFTTNPRFSRSSPYPSDVAKMIEAPIFHVNGDDPEAVVHATKVAIEFRMKFHKPVVVDMFCYRRFGHNEGDEPAFTQPIMYRNIRTHKTTVQIYADRLIAEGHITQAELDQMKADWRAHLESEWEVGQHYKPNKADWLDGAWSGLRTADNQDEQRRGKTAVPVKTLKEIGKKLTEVPKGFEAHKTIIRFLENRREAIESGEGIDWSTAEALAFGAILLDGNPIRLSGQDSERGTFSQRHSVLYDQRDETRYIPLNNLSAAQAGYEVINSMLSEEAVLGFEYGYSLAEPKALTLWEAQFGDFANGAQVVFDQFISSGERKWLRMSGLVCLLPHGYEGQGPEHSSARLERFLQLCAEDNMQVANCTTPANYFHILRRQLKRDFRKPLILMTPKSLLRHKRAVSTLPEISGESSFHRLLWDDAQLLPNQPIKLTKDSKIRRVVLCSGKVYYDLYEEREKRGINDIYLLRVEQLYPFPAKALITELSRFRNAEMVWCQEEPKNMGAWSFIDPYLEWVLAHIDAKHQRVRYTGRPAAASPATGLMSKHLAQLAALLEDALGE

SEQ ID NO: 47 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 48 - DNA, 1728 bp, Issatchenkia orientalis
atgactgacaaaatctccctaggtacttatctgtttgaaaagttaaaggaagcaggctcttattccatctttggtgttcctggtgatttcaatttggcattgttggaccacgtcaaggaagttgaaggcattagatgggtcggtaacgctaacgagttgaatgccggctacgaagctgatggttatgcaagaatcaatggatttgcatccctaatcaccacctttggtgtcggtgaattgtctgccgtcaatgccattgcaggttcttatgctgaacacgtcccattgatccatattgttggtatgccttccttgtctgctatgaagaacaacttgttgttacaccataccttgggtgacacaagattcgacaacttcaccgaaatgtcaaagaaaatcagtgcaaaggttgaaattgtttacgatttggaatcagctccaaaattaattaataacttgattgaaaccgcttatcacacaaagagaccagtctacttgggacttccttccaactttgctgatgaattggttccagcggcattagttaaggaaaacaagttacatttagaagaacctctaaacaaccccgttgctgaagaagaattcattcataacgttgttgaaatggtcaagaaggcagaaaaaccaatcattctcgttgacgcttgtgctgcaagacataacatttctaaggaagtgagagagttggctaaattgactaaattccctgtcttcaccaccccaatgggtaaatctactgttgatgaagatgatgaagaattctttggcttatacttgggttctctatctgctccagatgttaaggacattgttggcccaaccgattgtatcttatccttaggtggtttaccttctgatttcaacaccggttccttctcatatggttacaccactaagaatgtcgttgaattccattccaactactgtaaattcaaatctgcaacttatgaaaacttgatgatgaagggcgcagtccaaagattgatcagcgaattgaagaatattaagtattccaatgtctcaactttatctccaccaaaatctaaatttgcttacgaatctgcaaaggttgctccagaaggtatcatcactcaagattacctgtggaagagattatcttacttcttaaagccaagagatatcattgtcactgaaactggtacttcctcctttggtgtcttggctacccacttaccaagagattcaaagtctatctcccaagtcttatggggttccattggtttctccttaccagctgcagttggtgctgcatttgctgctgaagatgcacacaaacaaactggcgaacaagaaagaagaactgttttgtttattggtgatggttctttacaattgactgtccaatcaatctcagatgctgcaagatggaacatcaagccatacatcttcatcttaaacaacagaggttacactatcgaaaagttgatccacggtcgtcatgaggactacaaccaaattcaaccatgggatcaccaattgttattgaagctctttgctgacaagacccaatatgaaaaccatgttgttaaatccgctaaggacttggacgctttgatgaaggatgaagcattcaacaaggaagataagattagagtcattgaattattcttggatgaattcgatgctccagaaatcttggttgctcaagctaaattatctgatgaaatcaactctaaagccgcttaa

SEQ ID NO: 49 - protein, 575 aa, Issatchenkia orientalis
MTDKISLGTYLFEKLKEAGSYSIFGVPGDFNLALLDHVKEVEGIRWVGNANELNAGYEADGYARINGFASLITTFGVGELSAVNAIAGSYAEHVPLIHIVGMPSLSAMKNNLLLHHTLGDTRFDNFTEMSKKISAKVEIVYDLESAPKLINNLIETAYHTKRPVYLGLPSNFADELVPAALVKENKLHLEEPLNNPVAEEEFIHNVVEMVKKAEKPIILVDACAARHNISKEVRELAKLTKFPVFTTPMGKSTVDEDDEEFFGLYLGSLSAPDVKDIVGPTDCILSLGGLPSDFNTGSFSYGYTTKNVVEFHSNYCKFKSATYENLMMKGAVQRLISELKNIKYSNVSTLSPPKSKFAYESAKVAPEGIITQDYLWKRLSYFLKPRDIIVTETGTSSFGVLATHLPRDSKSISQVLWGSIGFSLPAAVGAAFAAEDAHKQTGEQERRTVLFIGDGSLQLTVQSISDAARWNIKPYIFILNNRGYTIEKLIHGRHEDYNQIQPWDHQLLLKLFADKTQYENHVVKSAKDLDALMKDEAFNKEDKIRVIELFLDEFDAPEILVAQAKLSDEINSKAA

SEQ ID NO: 50 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 51 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 52 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 53 - protein, 557 aa, Acetobacter pasteurianus
MTYTVGMYLAERLVQIGLKHHFAVGGDYNLVLLDQLLLNKDMKQIYCCNELNCGFSAEGYARSNGAAAAVVTFSVGAISAMNALGGAYAENLPVILISGAPNSNDQGTGHILHHTIGKTDYSYQLEMARQVTCAAESITDAHSAPAKIDHVIRTALRERKPAYLDIACNIASEPCVRPGPVSSLLSEPEIDHTSLKAAVDATVALLKNRPAPVMLLGSKLRAANALAATETLADKLQCAVTIMAAAKGFFPEDHAGFRGLYWGEVSNPGVQELVETSDALLCIAPVFNDYSTVGWSGMPKGPNVILAEPDRVTVDGRAYDGFTLRAFLQALAEKAPARPASAQKSSVPTCSLTATSDEAGLTNDEIVRHINALLTSNTTLVAETGDSWFNAMRMTLAGARVELEMQWGHIGWSVPSAFGNAMGSQDRQHVVMVGDGSFQLTAQEVAQMVRYELPVIIFLINNRGYVIEIAIHDGPYNYIKNWDYAGLMEVFNAGEGHGLGLKATTPKELTEAIARAKANTRGPTLIECQIDRTDCTDMLVQWGRKVASTNARKTTLA

SEQ ID NO: 54 - protein, 528 aa, Pseudomonas putida [sequence omitted]

SEQ ID NO: 55 - protein, 528 aa, Pseudomonas aeruginosa
MKTVHSASYEILRRHGLTTVFGNPGSNELPFLKDFPEDFRYILGLHEGAVVGMADGFALASGRPAFVNLHAAAGTGNGMGALTNAWYSHSPLVITAGQQVRSMIGVEAMLANVDAGQLPKPLVKWSHEPACAQDVPRALSQAIQTASLPPRAPVYLSIPYDDWAQPAPAGVEHLAARQVSGAALPAPALLAELGERLSRSRNPVLVLGPDVDGANANGLAVELAEKLRMPAWVAPSASRCPFPTRHACFRGVLPAAIAGISRLLDGHDLILVVGAPVFRYHQFAPGDYLPAGAELVQVTCDPGEAARAPMGDALVGDIALTLEALLEQVRPSARPLPEALPRPPALAEEGGPLRPETVFDVIDALAPRDAIFVKESTSTVTAFWQRVEMREPGSYFFPAAGGLGFGLPAAVGAQLAQPRRQVIGIIGDGSANYGITALWSAAQYRVPAVFIILKNGTYGALRWFAGVLEVPDAPGLDVPGLDFCAIARGYGVEALHAATREELEGALKHALAADRPVLIEVPTQTIEP

SEQ ID NO: 56 - protein, 526 aa, Pseudomonas stutzeri
MASVHSITYELLRRQGIDTVFGNPGSNELPFLKDFPEDFRYILALQEACVVGIADGYAQASRKPAFINLHSAAGTGNAMGAMSNAWNCHSPLIVTAGQQNRAMIGVEALLTNVDAASLPRPLVKWSYEPASAAEVPHAMSRAIHMASMAPRGPVYLSVPYDDWDKEADPQSHHLYDRSVNSAVRLNDQDLEVLVEALNSASNPAIVLGPDVDSANANADCVTLAERLKAPVWVAPSAPRCPFPTRHPCFRGLMPAGIAAISQLLEGHDVVLVIGAPVFRYHQYDPGQYLKPGTRLISITCDPLEAARAPMGDAIVADIGTMTAALASRIGESERQLPAVLPSPERVNQDAGRLRPETVFDTLNEMAPEDAIYLNESTSTTAQMWQRLNMRNPGSYYFCAAGGLGFALPAAIGVQLAEPDRQVIAVIGDGSANYSISALWTAAHYNIPAIFLIMNNGTYGALRWFAGVLEAENVPGLDVPGIDFCAIAKGYGIPALKADNLEQLKGSIHEALSAKGPVLIEVSTVSL

SEQ ID NO: 57 - protein, 528 aa, Pseudomonas fluorescens
MKTVHSASYDILRQQGLTTVFGNPGSNELPFLKGFPEDFRYILGLHEGAVVGMADGFALASGQPAFVNLHAAAGTGNGMGALTNAWYSHSPLVITAGQQVRSMIGVEAMLANVDAPQLPKPLVKWSAEPACAEDVPRALSQAIHMANQAPKGPVYLSIPYDDWARPAPAGVEHLARRQVATAGLPSAAQLRSLVQRLAAARNPVLVLGPDVDGSRSNHLAVQLAEKLRMPAWVAPSASRCPFPTRHPSFRGVLPAAIAGISRCLADHDLILVVGAPVFRYHQFAPGDYLPAGTELLHITCDPGEAARAPMGDALVGDIVETLQALVWALPDCDRPQPQALPPAAPVEELGGLLRPETVFDVIDELAPKDAIYVKESTSTVGAFWQRVEMREPGSYYFPAAGGLGFGLPAAVGVQLARPERRVIGVIGDGSANYGITALWTAAQYQIPVVFIILKNGTYGALRWFAGVLQVSDAPGLDVPGLDFCAIGRGYGVHSVQANTREAFAQALSEALAGDRPVLIEVPTLTIEP

SEQ ID NO: 58 - protein, 1220 aa, Chloroflexus aurantiacus
MATGESMSGTGRLAGKIALITGGAGNIGSELTRRFLAEGATVIISGRNRAKLTALAEMQAEAGVPAKRIDLEVMDGSDPVAVRAGIEAIVARHGQIDILVNNAGSAGAQRRLAEIPLTEAELGPGAEETLHASIANLLGMGWHLMRIAAPHMPVGSAVINVSTIFSRAEYYGRIPYVTPKAALNALSQLAARELGARGIRVNTIFPGPIESDRIRTVFQRMDQLKGRPEGDTAHHFLNTMRLCRANDQGALERRFPSVGDVADAAVFLASAESAALSGETIEVTHGMELPACSETSLLARTDLRTIDASGRTTLICAGDQIEEVMALTGMLRTCGSEVIIGFRSAAALAQFEQAVNESRRLAGADFTPPIALPLDPRDPATIDAVFDWAGENTGGIHWILPATSHEPAPCVIEVDDERVLNFLADEITGTIVIASRLARYWQSQRLTPGARARGPRVIFLSNGADQNGNVYGRIQSAAIGQLIRVWRHEAELDYQRASAAGDHVLPPVWANQIVRFANRSLEGLEFACAWTAQLLHSQRHINEITLNIPANISATTGARSASVGWAESLIGLHLGKVALITGGSAGIGGQIGRLLALSGARVMLAARDRHKLEQMQAMIQSELAEVGYTDVEDRVHIAPGCDVSSEAQLADLVERTLSAFGTVDYLINNAGIAGVEEMVIDMPVEGWRHTLFANLISNYSLMRKLAPLMKKQGSGYILNVSSYFGGEKDAAIPYPNRADYAVSKAGQRAMAEVFARFLGPEIQINAIAPGPVEGDRLRGTGERPGLFARRARLILENKRLNELHAALIAAARTDERSMHELVELLLPNDVAALEQNPAAPTALRELARRFRSEGDPAASSSSALLNRSIAAKLLARLHNGGYVLPADIFANLPNPPDPFFTRAQIDREARKVRDGIMGMLYLQRMPTEFDVAMATVYYLADRNVSGETFHPSGGLRYERTPTGGELFGLPSPERLAELVGSTVYLIGEHLTEHLNLLAMYLERYGARQVWIVETETGAETMRRLLHDHVEAGRLMTIVAGDQIEAAIDQAITRYGRPGPVVCTPFRPLPTVPLVGRKDSDWSTVLSEAEFAELCEHQLTHHFRVARKIALSDGASLALVTPETTATSTTEQFALANFIKTTLHAFTATIGVESERTAQRILINQVDLTRRARAEEPRDPHERQQELERFIEAVLLVTAPLPPEADTRYAGRIHRGRAITV

SEQ ID NO: 59 - protein, 1229 aa, Roseiflexus castenholzii
MSTVRRLEGKVALITGGAGNIGEVITRRFLAEGATVVITGRNAEKLAVYRRRLIDEERVAPERVVALRMDGSDIAQVRAGVAQIVHGGTDVPIPLHRIDILVNNAGSAGPRRRLVDIPLEPSEVQPPDSETLAQAVGNLVGITWNLTRAAAPHMPSGSSVINISTIFSRTDYYGRIAYVAPKAALNALSDGLARELGVRGIRVNTIYPGPIESERIYTMFQAMDALKGQPEGDTASGFLRMMRLSRIDQNGEVVKRFPSPVDVANTAVFLASDESAAFTGHAFEVTHGMEVPTESRTTFVSRPGLRSVDATGKVILICAGDQVDDAVALADTLRSCRATVVIGFRDPRALEKASVLLREPRHALAADMYGRPTMTAEARLVRLDPLDPRAAAQTLEQIHAELGAIHHAVVLPGQSRHAPSASLIEVDDQVVERFLHQELVGTIALARELARFWEEYPSGSSMHRVLFVSNPDDQQGNQYSHILRAAVEQLVRVWRHESEYDSVNPAHQQEGQSSAAVWANQLIRYVNNEMANLDFTCAWVAKLLGSDRRIAEINLYLPEEIVGTIGVHNPGFGWAESLFGLHMGKVALITGGSAGIGGQIGRLLALSGAHVMLAARNADQLEQMRASIVREVRDASYPDAESRVAIFPGSDVSDIDGLERLVNHTVRVFGKVDYLINNAGIAGAEEMVIDMPVDAWRHTLRANLISNYALLRRLAPQMKAAGGAYVLNVSSYFGGEKYVAIPYPNRSDYAVSKAGQRAMVESLARFLGPEIQINAIAPGPVEGERLKGAGSRPGLFMRRARLILENKRLNEVFAALLAARHEGATIADLLPDLFANDIQSIANSAAMPAPLRRLATMLRETSDAGGSAQSYLMNATIARKLLNRLENGGYITLHDRRALTVEPPEPFFTEAQIEREAIKVRDGILGMLHLQRMPTEFDVALATVFYLADRNVTGETFHPSGGLRFERTVTEGELFGKPGQQRLERLKGSVVYLIGEHLRQHLVLLARTFLDEIHVARVVLLTETTQAATDLAAELSDYEAAGRFVVIPTCGDIEGGIDRAMAEYGRPGPVISTPFRPLPDRALSARNGDWSSVLTTAEFEELVEQQITHHFRVARKAGLIEGANVTLVTPPTSARSTSEEFALANFVKTTLHALTATAGAESERTVPHVPVNQVDLTRRARSEEPRTPSEEEEELQRFVNAVLLTSAPLPTPLESRYRARIYRGNAITV

SEQ ID NO: 60 - protein, 1217 aa, Erythrobacter sp.
MSKEGNAAKGRLEGKVALITGAAGNLGNEISRAFAREGAFVVMTGRTEERISAAREQLIADTGVAPERIDTAVLDGGNPDSIRAAMAKLRKEYGRIDILINNAGSAGPKQPLHNVPLSPQEMEACGDTETVRDAMLNILGVTWNMARIVAPMMPVGGAMVNISTIFSHTRYYGRTAYVVPKAALNALSNQLASELGPRGIRVNTVFPGPIESDRIRTVFAAMDEVQSQPKDTTANYFTGRMALTRSVNGKVDGKPLPNPKDIAGTCLFLASEEAAGIAGEEVDVTHGLSANRTSASTYMTRPSMRSLDGAGLNIFIVSGENWDDALVAAHTLIGSGAKVRLGLARNADVAQANARLKAQGIGEELTVTRFNRAEPDAMEDALAAFSGDVDGAITGAIILPVKPSGHFTGSLLAADDDTVTKFMDTELVGAIAVSRSLARYWHGREDLQSPPRCVFMTNPGDPLGNSFASVLSAGITQLIRIWRDEERVQAGNGSTEHAVWSNQIVRHTNTEDENTRFASGHATRVLFREQHIAEIDLKLPANISEETGSRKAMVGFAENITGLHLGKVAFITGGSAGIGGQVARLLALAGAKVMMVARRESELVAARDRIVGELQDIGFAGVERRVKYMADIDVSDFASLDKAVDATLEEFGRIDYLINNAGVAGAEDMVIDMEPEAWRFTLDANLISNYHLMQRVVPLMKEQGSGYVLNVSSYFGGEKFLAVAYPNRADYGLSKAGQRAMVEAFSPFLGPEVQCNAIAPGPVDGDRLSGTGGKPGLFQRRAKLILENKRLNAVYSAVIHAIREGGDAAKILTRLSRNSTSTLSHDAEAPEELRKLALDFASQGDGLCTWDQYLLTDAMAQRLLVRLQLGGFLLGSNEWASLSSSEQTWLKLSPPDDKPFLPAAQVDKVANGVGKGVISQLHLGAMPTEAEVAQATVFFLADRAVSGETFMPSGGLRVERSNTEREMFGSPKQERIDKMKGKTVWIIGEHLSDYVAATIEELVSGCGVAKVVLIAKDKSGEKAVRDQLPNDLSKDALEVLIAGDGLEEAMDEALGHWGKPTTVLSMPGEPLPDHLFEGGNPLSTKDFAHMVEANITRHYRVTRKASLYDGCQVVLVSPDVPYGSDGPGVALANFVKTSLHAFTATVAVENERLVHDVPVNQINLTRRVSSEEPRDADEHAEELRRFTRAVLLVGAPLPDAQDSRYRSKIYRGTSMTV

SEQ ID NO: 61 - protein, 357 aa, Metallosphaera sedula
MRRTLKAAILGATGLVGIEYVRMLADHPYIKPTYLAGKGSVGKPYGEIVRWQTVGNVPKEVANQEVKPTDPKLMDDVDIIFSPLPQGAAGPVEEQFAKLGFNVISNSPDHRFDMDVPMIIPEVNPHTVTLIDEQRKRRDWKGFIVTTPLCTAQGAAIPLTPIYQNFKMSGVMITTMQSLSGAGYPGIASLDIVDNALPLGDGYDAKTVKEITRILSEVKRNVQEPGVNEITLDATTHRIATIHGHYEVAYVTFKEDTDVRKVMESMESFKGEPQDLKLPTAPEKPIIVTTQDARPQVFFDRWAGNPPGMSVVVGRLKQVNPRTIRFVSLIHNTVRGAAGGGVLTAELLVEKGYIDKR

SEQ ID NO: 62 - protein, 356 aa, Sulfolobus tokodaii
MRRTLKAAILGATGLVGIEYVRMLSNHPYIKPAYLAGKGSVGKPYGEVVRWQTVGQVPKEIADMEIKPTDPKLMDDVDIIFSPLPQGAAGPVEEQFAKEGFPVISNSPDHRFDPDVPLLVPELNPHTISLIDEQRKRREWKGFIVTTPLCTAQGAAIPLGAIFKDYKMDGAFITTIQSLSGAGYPGIPSLDVVDNILPLGDGYDAKTIKEIFRILSEVKRNVDEPKLEDVSLAATTHRIATIHGHYEVLYVSFKEETAAEKVKETLENFRGEPQDLKLPTAPSKPIIVMNEDTRPQVYFDRWAGDIPGMSVVVGRLKQVNKRMIRLVSLIHNTVRGAAGGGILAAELLVEKGYIEK

SEQ ID NO: 63 - protein, 482 aa, Saccharomyces cerevisiae
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDSKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISISKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 64 - protein, 420 aa, Saccharomyces cerevisiae
MLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 65 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 66 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 67 - protein, 887 aa, Escherichia coli
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 68 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 69 - protein, 474 aa, Escherichia coli [sequence omitted]

SEQ ID NO: 70 - protein, 371 aa, Bacillus subtilis
MAAKTKKAIVDSKKQFDAIKKQFETFQILNEKGEVVNEAAMPDLTDDQLKELMRRMVFTRVLDQRSISLNRQGRLGFYAPTAGQEASQIATHFALEKEDFVLPGYRDVPQLIWHGLPLYQAFLFSRGHFRGNQMPDDVNALSPQIIIGAQYIQTAGVALGLKKRGKKAVAITYTGDGGASQGDFYEGINFAGAYKAPAIFVVQNNRYAISTPVEKQSAAETIAQKAVAAGIVGVQVDGMDPLAVYAATAEARERAINGEGPTLIETLTFRYGPHTMAGDDPTKYRTKEIENEWEQKDPLVRFRAFLENKGLWSEEEEAKVIEDAKEEIKQAIKKADAEPKQKVTDLMKIMYEKMPHNLEEQFEIYTQKESK

SEQ ID NO: 71 - protein, 325 aa, Bacillus subtilis
MAQMTMIQAITDALRTELKNDENVLVFGEDVGVNGGVFRATEGLQKEFGEDRVFDTPLAESGIGGLALGLGLNGFRPVMEIQFFGFVYEVMDSVSGQMARMRYRSGGRWTSPVTIRSPFGGGVHTPELHADSLEGLVAQQPGIKVVIPSTPYDAKGLLISAIRDNDPVVFLEHMKLYRSFRQEVPEEEYTIELGKADVKREGTDLSIITYGAMVHESLKAADELEKDGISAEVVDLRTVSPLDIDTIIASVEKTGRAIVVQEAQKQAGIAANVVAEINDRAILSLEAPVLRVAAPDTVFPFSQAESVWLPNHKDVLETARKVLEF

SEQ ID NO: 72 - protein, 442 aa, Bacillus subtilis
MAFEFKLPDIGEGIHEGEIVKWFVKPNDEVDEDDVLAEVQNDKAVVEIPSPVKGKVLELKVEEGTVATVGQTIITFDAPGYEDLQFKGSDESDDAKTEAQVQSTAEAGQDVAKEEQAQEPAKATGAGQQDQAEVDPNKRVIAMPSVRKYAREKGVDIRKVTGSGNNGRVVKEDIDSFVNGGAQEAAPQETAAPQETAAKPAAAPAPEGEFPETREKMSGIRKAIAKAMVNSKHTAPHVTLMDEVDVTNLVAHRKQFKQVAADQGIKLTYLPYVVKALTSALKKFPVLNTSIDDKTDEVIQKHYFNIGIAADTEKGLLVPVVKNADRKSVFEISDEINGLATKAREGKLAPAEMKGASCTITNIGSAGGQWFTPVINHPEVAILGIGRIAEKAIVRDGEIVAAPVLALSLSFDHRMIDGATAQNALNHIKRLLNDPQLILMEA

SEQ ID NO: 73 - protein, 470 aa, Bacillus subtilis
MVVGDFPIETDTLVIGAGPGGYVAAIRAAQLGQKVTVVEKATLGGVCLNVGCIPSKALINAGHRYENAKHSDDMGITAENVTVDFTKVQEWKASVVNKLTGGVAGLLKGNKVDVVKGEAYFVDSNSVRVMDENSAQTYTFKNAIIATGSRPIELPNFKYSERVLNSTGALALKEIPKKLVVIGGGYIGTELGTAYANFGTELVILEGGDEILPGFEKQMSSLVTRRLKKKGNVEIHTNAMAKGVEERPDGVTVTFEVKGEEKTVDADYVLITVGRRPNTDELGLEQVGIEMTDRGIVKTDKQCRTNVPNIYAIGDIIEGPPLAHKASYEGKIAAEAIAGEPAEIDYLGIPAVVFSEPELASVGYTEAQAKEEGLDIVAAKFPFAANGRALSLNETDGFMKLITRKEDGLVIGAQIAGASASDMISELSLAIEGGMTAEDIAMTIHAHPTLGEITMEAAEVAIGSPIHIVK

SEQ ID NO: 74 - protein, 2123 aa, Saccharomyces cerevisiae
MRSIRKWAYETFNDEKIIQFVVMATPDDLHANSEYIRMADQYVQVPGGTNNNNYANIDLILDVAEQTDVDAVWAGWGHASENPCLPELLASSQRKILFIGPPGRAMRSLGDKISSTIVAQSAKIPCIPWSGSHIDTIHIDNKTNFVSVPDDVYVRGCCSSPEDALEKAKLIGFPVMIKASEGGGGKGIRRVDNEDDFIALYRQAVNETPGSPMFVMKVVTDARHLEVQLLADQYGTNITLFGRDCSIQRRHQKIIEEAPVTITKPETFQRMERAAIRLGELVGYVSAGTVEYLYSPKDDKFYFLELNPRLQVEHPTTEMISGVNLPATQLQIAMGIPMHMISDIRKLYGLDPTGTSYIDFKNLKRPSPKGHCISCRITSEDPNEGFKPSTGKIHELNFRSSSNVWGYFSVGNNGAIHSFSDSQFGHIFAVGNDRQDAKQNMVLALKDFSIRGEFKTPIEYLIELLETRDFESNNISTGWLDDLILKNLSSDSKLDPTLAIICGAAMKAYVFTEKVRNKYLELLRRGQVPPKDFLKTKFPVDFIFDNNRYLFNVAQSSEEQFILSINKSQCEVNVQKLSSDCLLISVDGKCHTVYWKDDIRGTRLSIDSNTIFLEAELNPTQVISPTPGKLVKYLVRSGDHVFAGQQYAEIEIMKMQMPLVAKSDGVIELLRQPGSIIEAGDVIAKLTLDSPSKANESSLYRGELPVLGPPLIEGSRPNHKLRVLINRLENILNGYHENSGIETTLKELIKILRDGRLPYSEWDSQISTVRNRLPRQLNEGLGNLVKKSVSFPAKELHKLMKRYLEENTNDHVVYVALQPLLKISERYSEGLANHECEIFLKLIKKYYAVEKIFENHDIHEERNLLNLRRKDLTNLKKILCISLSHANVVAKNKLVTAILHEYEPLCQDSSKMSLKFRAVIHDLASLESKWAKEVAVKARSVLLRGIFPPIKKRKEHIKTLLQLHIKDTGAENIHSRNIYSCMRDFGNLIHSNLIQLQDLFFFFGHQDTALSSIASEIYARYAYGNYQLKSIKIHKGAPDLLMSWQFSSLRNYLVNSDGESDEFTKLSKPPSTSGKSSANSFGLLVNMRALESLEKTLDEVYEQIHIPEERLSSGENSLIVNILSPIRYRSENDLIKTLKIKLHENERGLSKLKVNRITFAFIAANAPAVKFYSFDGTTYDEISQIRNMDPSYEAPLELGKMSNYKIRSLPTYDSSIRIFEGISKFTPLDKRFFVRKIINSFMYNDQKTTEENLKAEINAQVVYMLEHLGAVDISNSDLNHIFLSFNTVLNIPVHRLEEIVSTILKTHETRLFQERITDVEICISVECLETKKPAPLRLLISNKSGYVVKIETYYEKIGKNGNLILEPCSEQSHYSQKSLSLPYSVKDWLQPKRYKAQFMGTTYVYDFPGLFHQAAIQQWKRYFPKHKLNDSFFSWVELIEQNGNLIKVNREPGLNNIGMVAFEIMVQTPEYPEGRNMIVISNDITYNIGSFGPREDLFFDRVTNYARERGIPRIYLAANSGAKLGIAEELIPLFRVAWNDPSDPTKGFQYLYLAPKDMQLLKDSGKGNSVVVEHKMVYGEERYIIKAIVGFEEGLGVECLQGSGLIAGATSKAYRDIFTITAVTCRSVGIGSYLVRLGQRTIQVEDKPIILTGASAINKVLGTDIYTSNLQIGGTQIMYKNGIAHLTASNDMKAIEKIMTWLSYVPAKRDMSPPLLETMDRWDRDVDFKPAKQVPYEARWLIEGKWDSNNNFQSGLFDKDSFFETLSGWAKGVIVGRARLGGIPVGVIAVETKTIEEIIPADPANLDSSEFSVKEAGQVWYPNSAFKTAQTINDFNYGEQLPLIILANWRGFSGGQRDMYNEVLKYGSFIVDALVDYKQPILIYIPPFGELRGGSWVVIDPTINPEQMEMYADVESRGGVLEPDGVVSIKYRKEKMIETMIRLDSTYGHLRRTLTEKKLSLEKQNDLTKRLKIRERQLIPIYNQISIQFADLHDRSTRMLVKGVIRNELEWKKSRRFLYWRLRRRLNEGQVIKRLQKKTCDNKTKMKYDDLLKIVQSWYNDLDVNDDRAVVEFIERNSKKIDKNIEEFEISLLIDELKKKFEDRRGNIVLEELTRLVDSKRKR

SEQ ID NO: 75 - protein, 319 aa, Escherichia coli
MSLNFLDFEQPIAELEAKIDSLTAVSRQDEKLDINIDEEVHRLREKSVELTRKIFADLGAWQIAQLARHPQRPYTLDYVRLAFDEFDELAGDRAYADDKAIVGGIARLDGRPVMIIGHQKGRETKEKIRRNFGMPAPEGYRKALRLMQMAERFKMPIITFIDTPGAYPGVGAEERGQSEAIARNLREMSRLGVPVVCTVIGEGGSGGALAIGVGDKVNMLQYSTYSVISPEGCASILWKSADKAPLAAEAMGIIAPRLKELKLIDSIIPEPLGGAHRNPEAMAASLKAQLLADLADLDVLSTEDLKNRRYQRLMSYGYA

SEQ ID NO: 76 - protein, 156 aa, Escherichia coli
MDIRKIKKLIELVEESGISELEISEGEESVRISRAAPAASFPVMQQAYAAPMMQQPAQSNAAAPATVPSMEAPAAAEISGHIVRSPMVGTFYRTPSPDAKAFIEVGQKVNVGDTLCIVEAMKMMNQIEADKSGTVKAILVESGQPVEFDEPLVVIE

SEQ ID NO: 77 - protein, 449 aa, Escherichia coli
MLDKIVIANRGEIALRILRACKELGIKTVAVHSSADRDLKHVLLADETVCIGPAPSVKSYLNIPAIISAAEITGAVAIHPGYGFLSENANFAEQVERSGFIFIGPKAETIRLMGDKVSAIAAMKKAGVPCVPGSDGPLGDDMDKNRAIAKRIGYPVIIKASGGGGGRGMRVVRGDAELAQSISMTRAEAKAAFSNDMVYMEKYLENPRHVEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVHVRGHAVECRINAEDPNTFLPSPGKITRFHAPGGFGVRWESHIYAGYTVPPYYDSMIGKLICYGENRDVAIARMKNALQELIIDGIKTNVDLQIRIMNDENFQHGGTNIHYLEKKLGLQEK

SEQ ID NO: 78 - protein, 304 aa, Escherichia coli
MSWIERIKSNITPTRKASIPEGVWTKCDSCGQVLYRAELERNLEVCPKCDHHMRMTARNRLHSLLDEGSLVELGSELEPKDVLKFRDSKKYKDRLASAQKETGEKDALVVMKGTLYGMPVVAAAFEFAFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPEAPREGVVVPPVPDQEPEA

SEQ ID NO: 79 - protein, 282 aa, Chloroflexus aurantiacus
MEETAIPQSLTPWDRVQLARHPQRPHTLDYIAALCEDFVELHGDRRFGDDPAMVGGMATFAGQTVMVIGHQKGNDTRENMRRNFGMPHPEGYRKAQRLMRHAEKFGLPVICFVDTPAADPTKSSEERGQANAIAESIMLMTTLRVPSIAVVIGEGGSGGALAISVADRILMQENAIYSVAPPEAAASILWRDAAKAPEAARALKLTAADLYDLRIIDEVIPEPPGGAHADRLTAITTVGERLRVHLADLQQRDIDTLLRERYRKYRSMGQYQEQQMDFFGRM

SEQ ID NO: 80 - protein, 180 aa, Chloroflexus aurantiacus
MMLWGAMKDETTELPADQPDPFGLAAVRVLLQMLEQSDVYEITIENGNAKLHVKRGQPGGVIYSAPLPTAPVPSPSLPATPVTPFVQPPPAPEGPPVEMPAGHTITAPMVGTFYAAPSPRDRPFVQEGDEVRVGDTVGIVEAMKMMNEIESDVAGRVARILVKNGQPVEYGQPLMVIEPL

SEQ ID NO: 81 - protein, 455 aa, Chloroflexus aurantiacus
MIRKVLVANRGEIAVRIIRACQELGIRTVVAYSTADRDSLAVRLADEAVCIGPPPAAKSYLNAPALISAALVSGCDAIHPGYGFLSENPYFAEMCADCKLTFIGPPPEPIRLMGDKAIGRETMRKAGVPTVPGSDGEVRSLEEAIDVARQIGYPVLLKPSGGGGGRGMRVAYDEADLQRAFPTARAEAEAAFGNGALLLEKYLTRVRHVEIQVLADQYGHAIHLGERDCSAQRRHQKIVEEAPSPAVTPELRERMGADAVRGIKSIGYVNAGTLEFLLDQDGNYYFIEMNTRIQVEHPVTEQVTGIDLVRWQLLIASGERLTLRQEDIKITRHAIECRINAEDPERDFLPASGEVEFYLPPGGPGVRVDSHLYSGYTPPGTYDSLLAKIITFGDTRDEALNRMRRALNECVITGIKTTIPFQLALIDDPEFRAGRIHTGYVAELLRQWKETLNPV

SEQ ID NO: 82 - protein, 305 aa, Chloroflexus aurantiacus
MKEFFRLSRKGFTGREDQDSAQIPDDLWVKCSSCRELIYKKQLNDNLKVCPKCGHHMRLSAHEWLGLLDVGSFREMDANLLPTDPLGFVTDEESYAAKLAKTQQRTGMADAVIAGIGAISNMQICVAVADFSFMGASMGSVYGEKMARSAERAAELGVPLLTINTSGGARQQEGVIGLMQMAKVTMALTRLADAGQPHIALLVDPCYGGVTASYPSVADIIIAEPGANIGFAGKRLIEQIMRQKLPAGFQTAEFMLEHGMIDMVVPRSEMRDTLARILRLYRQRSTSPAKAELAGRRATLPQPIM

SEQ ID NO: 83 - protein, 378 aa, Bacillus subtilis
MIIGVPKEIKNNENRVALTPGGVSQLISNGHRVLVETGAGLGSGFENEAYESAGAEIIADPKQVWDAEMVMKVKEPLPEEYVYFRKGLVLFTYLHLAAEPELAQALKDKGVTAIAYETVSEGRTLPLLTPMSEVAGRMAAQIGAQFLEKPKGGKGILLAGVPGVSRGKVTIIGGGVVGTNAAKMAVGLGADVTIIDLNADRLRQLDDIFGHQIKTLISNPVNIADAVAEADLLICAVLIPGAKAPTLVTEEMVKQMKPGSVIVDVAIDQGGIVETVDHITTHDQPTYEKHGVVHYAVANMPGAVPRTSTIALTNVTVPYALQIANKGAVKALADNTALRAGLNTANGHVTYEAVARDLGYEYVPAEKALQDESSVAGA

SEQ ID NO: 84 - protein, 505 aa, Schizosaccharomyces pombe
MFTDYPNDINCESPRMSDLDGFCQNAFSDLNSLNQQVFKANYAVRGALAILADEIQDDLLENPSSYPFSEIVYANIGNPQQMGQSPITFVRQVLSLCQYPTLLDHAEEKWFQNLFPTDVVQRSKMLLKESGSLGAYSASQGIPLVRRHVADFIRARDGFDCEPSDIYLTSGASHAARLIMTLIIARPTDGVMVPAPQYPLYGAQIDLMSGSMVSYSLSEENNWDIDFDQFKKSFDEASKKGINVRLCVVINPGNPTGACISENSMEKVLRFAKAKGIVLLADEVYQNNIYQNKFHSFRRKLGELREKEPDNHWDQVSLISVNSVSKGQFGECGQRGGYLDVVNIPEPAKDQILKLATIDICPPVAGQLLVDMLVNPPKPGDPSYDLFIKEVDEIHEALRLQCRQLYEGTKRMKRVSCLEPHGAMYLHPSVSLPEKLITTAKAQKIQPDEFYAIELLKRSGICVVPGSGFGQPEGDYHIRITFLAKGTEYIERFVKAHNEIMDLYE

SEQ ID NO: 85 - protein, 507 aa, Saccharomyces cerevisiae
MTMTHQQDLKGVFTAKDLDFKPAGKITKKDLNTGVTKAEYAVRGAIPTRADELKEELKKNPEVLPFDDIINANIGNPQQLDQKPLTFTRQVLAILEYPEILRVGHNELASLNLFSRDALERAERLLNDIGGSIGAYSHSQGVPGIRQTVADFITRRDGGEPATPEDIYLTTGASSAATSLLSLLCKDSQTGLLIPIPQYPLYTASASLFNAQVLPYYLDEESNWSTNSDEIEKVVQDALKKQIRPSVLIVINPGNPTGAVLSEETIARICLIAAKYGITIISDEVYQENIFNDVKFHSMKKVLRKLQHLYPGKFDNVQLASLHSISKGFMDECGQRGGYMEIIGFSQEIRDALFKLMSISICSVVTGQAVVDLMVKPPQPGDESYEQDHDERLKIFHEMRTRANLLYETFKELEGIECQKPQGAMYLFPRLVLPKKALCESERLGIEPDEFYCTSLLESTGICTVPGSGFGQRPGTYHVRTTFLAPGTKWIQDWKEFHQDFFSKYRN

SEQ ID NO: 86 - protein, 471 aa, Bacillus subtilis
MKNKWYKPKRHWKEIELWKDVPEEKWNDWLWQLTHTVRTLDDLKKVINLTEDEEEGVRISTKTIPLNITPYYASLMDPDNPRCPVRMQSVPLSEEMHKTKYDLEDPLHEDEDSPVPGLTHRYPDRVLFLVTNQCSMYCRYCTRRRFSGQIGMGVPKKQLDAAIAYIRETPEIRDCLISGGDGLLINDQILEYILKELRSIPHLEVIRIGTRAPVVFPQRITDHLCEILKKYHPVWLNTHFNTSIEMTEESVEACEKLVNAGVPVGNQAVVLAGINDSVPIMKKLMHDLVKIRVRPYYIYQCDLSEGIGHFRAPVSKGLEIIEGLRGHTSGYAVPTFVVDAPGGGGKIALQPNYVLSQSPDKVILRNFEGVITSYPEPENYIPNQADAYFESVFPETADKKEPIGLSAIFADKEVSFTPENVDRIKRREAYIANPEHETLKDRREKRDQLKEKKFLAQQKKQKETECGGDSS

SEQ ID NO: 87 - protein, 416 aa, Porphyromonas gingivalis
MAESRRKYYFPDVTDEQWNDWHWQVLNRIETLDQLKKYVTLTAEEEEGVKESLKVLRMAITPYYLSLIDPENPNCPIRKQAIPTHQELVRAPEDQVDPLSEDEDSPVPGLTHRYPDRVLFLITDKCSMYCRHCTRRRFAGQKDASSPSERIDRCIDYIANTPTVRDVLLSGGDALLVSDERLEYILKRLREIPHVEIVRIGSRTPVVLPQRITPQLVDMLKKYHPVWLNTHFNHPNEVTEEAVEACERMANAGIPLGNQTVLLRGINDCTHVMKRLVHLLVKMRVRPYYIYVCDLSLGIGHFRTPVSKGIEIIENLRGHTSGYAVPTFVVDAPGGGGKIPVMPNYVVSQSPRHVVLRNYEGVITTYTEPENYHEECDCEDCRAGKHKEGVAALSGGQQLAIEPSDLARKKRKFDKN

SEQ ID NO: 88 - protein, 425 aa, Fusobacterium nucleatum
MNTVNTRKKFFPNVTDEEWNDWTWQVKNRIEKIDDLKKYVELSAEEEEGVVRTLETLRMAITPYYFSLIDMNSDRCPIRKQAIPTIQEIHQSDADLLDPLHEDEDSPVPGLTHRYPDRVLLLITDMCSMYCRHCTRRRFAGSSDDAMPMDRIDKAIEYIAKTPQVRDVLLSGGDALLVSDKKLESIIQKLRAIPHVEIIRIGSRTPVVLPQRITPELCNMLKKYHPIWLNTHFNHPQEVTPEAKKACEMLADAGVPLGNQTVLLRGINDSVPVMKRLVHDLVMMRVRPYYIYQCDLSMGLEHFRTPVSKGIEIIEGLRGHTSGYAVPTFVVDAPGGGGKTPVMPQYVISQSPHRVVLRNFEGVITTYTEPENYTHEPCYDEEKFEKMYEISGVYMLDEGLKMSLEPSHLARHERNKKRAEAEGKK

SEQ ID NO: 89 - protein, 517 aa, Megasphaera elsdenii
MRKVEIITAEQAAQLVKDNDTITSIGFVSSAHPEALTKALEKRFLDTNTPQNLTYIYAGSQGKRDGRAAEHLAHTGLLKRAIIGHWQTVPAIGKLAVENKIEAYNFSQGTLVHWFRALAGHKLGVFTDIGLETFLDPRQLGGKLNDVTKEDLVKLIEVDGHEQLFYPTFPVNVAFLRGTYADESGNITMDEEIGPFESTSVAQAVHNCGGKVVVQVKDVVAHGSLDPRMVKIPGIYVDYVVVAAPEDHQQTYDCEYDPSLSGEHRAPEGATDAALPMSAKKIIGRRGALELTENAVVNLGVGAPEYVASVAGEEGIADTITLTVEGGAIGGVPQGGARFGSSRNADAIIDHTYQFDFYDGGGLDIAYLGLAQCDGSGNINVSKFGTNVAGCGGFPNISQQTPNVYFCGTFTAGGLKIAVEDGKVKILQEGKAKKFIKAVDQITFNGSYAARNGKHVLYITERCVFELTKEGLKLIEVAPGIDIEKDILAHMDFKPIIDNPKLMDARLFQDGPMGLKK

SEQ ID NO: 90 - protein, 145 aa, Clostridium propionicum
MVGKKVVHHLMMSAKDAHYTGNLVNGARIVNQWGDVGTELMVYVDGDISLFLGYKDIEFTAPVYVGDFMEYHGWIEKVGNQSYTCKFEAWKVATMVDITNPQDTRATACEPPVLCGRATGSLFIAKKDQRGPQESSFKERKHPGE

SEQ ID NO: 91 - protein, 260 aa, Phytophthora sojae
MAAEYESILTEVRGKVAIITLNRPKALNALCSPLIEELNGAAHAFDADPSIGAIVITGSGSKAFAAGADIKEMATKTFVDAYKSNMFANWGDITKVSKPVIAAVNGYALGGGCELAMLCDLIIAGDSAKFGQPEITLGTIPGCGGTQRLIRAVGKSKAMEMILTGNMIDAQQAERDGLVARVVPADQLLDEALKTANKIASFSQPVVKMAKEAVNAAYEQSLQEGLKYESRLFWSSFATKDQKEGMAAFVEKRKADFKDE

SEQ ID NO: 92 - protein, 258 aa, Chloroflexus aurantiacus
MSEESLVLSTIEGPIAILTLNRPQALNALSPALIDDLIRHLEACDADDTIRVIIITGAGRAFAAGADIKAMANATPIDMLTSGMIARWARIAAVRKPVIAAVNGYALGGGCELAMMCDIIIASENAQFGQPEINLGIIPGAGGTQRLTRALGPYRAMELILTGATISAQEALAHGLVCRVCPPESLLDEARRIAQTIATKSPLAVQLAKEAVRMAAETTVREGLAIELRNFYLLFASADQKEGMQAFIEKRAPNFSGR

SEQ ID NO: 93 - protein, 288 aa, Rhodospirillum rubrum
MAAAPGPPAARPRAARQSRMILPPLREQAQMAYENILVETNGKVGIVTLNRPKALNALSAGLVRDLGAALDAFEADVNVHVIVLTGSDKAFAAGADIKEMAEKSYMDAYLEDFITKGWERVTTCRKPIIAAVAGFALGGGCEMAMMCDFIIAAQNAKFGQPEINLGTLPGAGGTQRLTRFVGKSKAMDMCLTGRMMDADEAWKCGLVSRIVPVDDLKDEVLKIAEAIADKSLPITMMVKEAVNAAYETTLAQGVRFERRLFQASFATDDQKEGMNAFIEKRQPSFTDR

SEQ ID NO: 94 - protein, 258 aa, Rhodobacter capsulatus
MSYQTLIVEIADGVALIRLNRPEALNALNSQLLGELAAALSTLDADPAVRCFVLTGSDKAFAAGADIKEMADKSFVDMLKLDFFGTEGDAILRTRKPVIAAVAGYALGGGCELAMMCDFILCAENAKFGQPEINLGVVAGIGGTQRLTRFVGKSKSMEMHLTGRFMDAAEAERSGLVSRVLPLADLLPEALATARKIAEKSAIATMVAKDCVNRAYETTLREGVLYERRVFHALFATEDQKEGMAAFAEKRPAKFADK

SEQ ID NO: 95 - protein, 290 aa, Homo sapiens
MAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 96 - protein, 399 aa, Pseudomonas fluorescens
MRVVLCKFALLRSHDGSSANILIKNNKSRELSMTAQVSTEASHAAILQDEVLAEVRNHIGHLTLNRPAGLNALTLQMVRSLTSQLQAWSDDPQVYAVVLRGAGEKAFCAGGDIRSLYDSFKNGDTLHQDFFVEEYALDLAIHHYRKPVLALMDGFVLGGGMGLVQGADLRVVTERSRLAMPEVAIGYFPDVGGSYFLPRIPGELGIYLGVTGVQIRAADALYCGLADWYLDSHKLADLDQKLDNLRWHDSPLKDLQGALARLAVQQLPDAPLAALRPAIDHFFALPDVPSIVEQLQQVTVADSHEWALNTVSLMQTRSPLAMAVTLEMLRRGRRLSLEQCFALELHLDRQWFERGDLIEGVRALIIDKDKSPRWNPPTLHGLALNHVESFFHHFEKVVK

SEQ ID NO: 97 - protein, 351 aa, Bacillus cereus
MTEQVLFSVSENGVATITLNRPKALNSLSYDMLQPIGQKLKEWEHDERIALIVLKGAGTKGFCAGGDIKTLYEARSNEVALQHAERFFEEEYEIDTYIYQYTKPIIACLDGIVMGGGVGLTNGAKYRIVTERTKWAMPEMNIGFFPDVGAAYFLNKAPGYTGRFVALTASILKASDVLFINAADYFMTSDSLPEFLTELESVNWHKEDDVHTNLKEVIRTFATAPNLESELAPSLEVINSHFAFDTIEEIIHSLEKDESSFALKTKEILLSKSPISLKVTLKQFIDGQDKSVEECFATDLILAKNFMRHEDFFEGVRSVVVDKDQNPNYKYKQLSDVSEEDVNRFFNLLNA

SEQ ID NO: 98 - protein, 381 aa, Homo sapiens
MWRLMSRFNAFKRTNTILHHLRMSKHTDAAEEVLLEKKGCAGVITLNRPKFLNALTLNMIRQIYPQLKKWEQDPETFVIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFFATTPRKTWLLPCINGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 99 - protein, 261 aa, Megasphaera elsdenii
VKTVYTLGIDVGSSSSKAVILEDGKKIVAHAVVEIGTGSTGPERVLDEVFKDTNLKIEDMANIIATGYGRFNVDCAKGEVSEITCHAKGALFECPGTTTILDIGGQDVKSIKLNGQGLVMQFAMNDKCAAGTGRFLDVMSKVLEIPMSEMGDWYFKSKHPAAVSSTCTVFAESEVISLLSKNVPKEDIVAGVHQSIAAKACALVRRVGVGEDLTMTGGGSRDPGVVDAVSKELGIPVRVALHPQAVGALGAALIAYDKIKK

SEQ ID NO: 100 - protein, 428 aa, Megasphaera elsdenii
MSEEKTVDIESMSSKEALGYFLPKVDEDARKAKKEGRLVCWSASVAPPEFCTAMDIAIVYPETHAAGIGARHGAPAMLEVAENKGYNQDICSYCRVNMGYMELLKQQALTGETPEVLKNSPASPIPLPDVVLTCNNICNTLLKWYENLAKELNVPLINIDVPFNHEFPVTKHAKQYIVGEFKHAIKQLEDLCGRPFDYDKFFEVQKQTQRSIAAWNKIATYFQYKPSPLNGFDLFNYMGLAVAARSLNYSEITFNKFLKELDEKVANKKWAFGENEKSRVTWEGIAVWIALGHTFKELKGQGALMTGSAYPGMWDVSYEPGDLESMAEAYSRTYINCCLEQRGAVLEKVVRDGKCDGLIMHQNRSCKNMSLLNNEGGQRIQKNLGVPYVIFDGDQTDARNFSEAQFDTRVEALAEMMADKKANEGGNH

SEQ ID NO: 101 - protein, 372 aa, Megasphaera elsdenii
MSQIDELISKLQEVSNHPQKTVLNYKKQGKGLVGMMPYYAPEEIVYAAGYLPVGMFGSQNPQISAARTYLPPFACSLMQADMELQLNGTYDCLDAVIFSVPCDTLRCMSQKWHGKAPVIVFTQPQNRKIRPAVDFLKAEYEHVRTELGRILNVKISDLAIQEAIKVYNENRQVMREFCDVAAQYPQIFTPIKRHDVIKARWFMDKAEHTALVRELIDAVKKEPVQPWNGKKVILSGIMAEPDEFLDIFSEFNIAVVADDLAQESRQFRTDVPSGIDPLEQLAQQWQDFDGCPLALNEDKPRGQMLIDMTKKYNADAVVICMMRFCDPEEFDYPIYKPEFEAAGVRYTVLDLDIESPSLEQLRTRIQAFSEIL

SEQ ID NO: 102 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 103 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 104 - protein, 495 aa, Klebsiella pneumoniae
MNFQHLAYWQEKAKNLAIETRLFINGEYCAAADNTTFETIDPAAQQTLAQVARGKKADVERAVKAARQAFDNGDWSQASPAQRKAILTRFADLMEAHREELALLETLDTGKPIRHSLRDDIPGAARAIRWYAEALDKVYGEVAPTGSNELAMIVREPIGVIAAVVPWNFPLLLACWKLGPALAAGNSVILKPSEKSPLTALRLAGLAKEAGLPDGVLNVVSGFGHEAGQALALHPDVEVITFTGSTRTGKQLLKDAGDSNMKRVWLEAGGKSANIVFADCPDLQQAVRATAGGIFYNQGQVCIAGTRLLLEESIADEFLARLKAEAQHWQPGNPLDPDTTMGMLIDNTHADNVHSFIRGGESQSTLFLDGRKNPWPAAVGPTIFVDVDPASTLSREEIFGPVLVVTRFKSEEEALKLANDSDYGLGAAVWTRDLSRAHRMSRRLKAGSVFVNNYNDGDMTVPFGGYKQSGNGRDKSLHALEKFTELKTIWIALES

SEQ ID NO: 105 - DNA, 1053 bp, Issatchenkia orientalis
atgtcttacgaaatcccacaaacacaaaaggcctgtgtcttttacgaaaacggcggcccaatcacatacaaggacattccagttccaaagccaaaacctactgagattttagtcaaggttctgtactctggtgtctgccacaccgacttgcacgcatggaagggtgactggcctctagctaccaagttgccattggttggtggtcacgaaggtgccggtgttgttgttgccaagggtgaaaacgtcacctcttttgagattggtgattacgcaggtatcaagtggttgaatggttcatgtatgggttgtgaattctgtgaacaaggtgctgaaccaaactgtcctaaggccgacttgagtggttacacccacgacggttccttccaacagtatgctactgctgacgctattcaagctgcacacatctccaaggaaaccgacttggctggtgttgctccaatcttgtgtgcaggtgtcactgtctacaaggctttaaagactgcagaccttagagcaggtgaatgggtttgtatttccggtgcagctggtggtttaggttctcttgctattcaatatgcaaaggctatgggtctgagagttgttggtattgacggtggtgacgaaaagaaggaattgtgtaaatcccttggtgctgaagcatttattgatttcacaaagaccaaggatatcgtcaaggctgtccaagaggcaaccaatggtggtccacatggtgtcatcaatgtctctgtctctgaagctgcaatttctcaatcttgtgaatacgttagacctctaggtaaggttgttcttgttggtttaccagcaggcgcacaagtcaaaactggtgtctttgaagccgttgtcaagtctattgaaattaagggttcttatgtcggtaacagaaaggataccgccgaagcacttgacttctacactagaggcttggtcaagtctccattcaagattgtcggtttatccgaattgccaaaagtctttgaactcatggaacagggtaagattttaggtagaatggtcttagacacctccaaataa

SEQ ID NO: 106 - protein, 350 aa, Issatchenkia orientalis
MSYEIPQTQKACVFYENGGPITYKDIPVPKPKPTEILVKVLYSGVCHTDLHAWKGDWPLATKLPLVGGHEGAGVVVAKGENVTSFEIGDYAGIKWLNGSCMGCEFCEQGAEPNCPKADLSGYTHDGSFQQYATADAIQAAHISKETDLAGVAPILCAGVTVYKALKTADLRAGEWVCISGAAGGLGSLAIQYAKAMGLRVVGIDGGDEKKELCKSLGAEAFIDFTKTKDIVKAVQEATNGGPHGVINVSVSEAAISQSCEYVRPLGKVVLVGLPAGAQVKTGVFEAVVKSIEIKGSYVGNRKDTAEALDFYTRGLVKSPFKIVGLSELPKVFELMEQGKILGRMVLDTSK

SEQ ID NO: 107 - DNA, 1131 bp, Issatchenkia orientalis
atgtttgcatcaaccttcagaagtcaagctgtaagagctgcaagatttactagattccaatccacttttgccattcctgagaagcaaatgggtgttatctttgaaactcatggtggtcctttacaatacaaggaaattccagttccaaaaccaaaaccaactgaaattttaatcaatgttaaatactctggtgtctgccataccgatttacacgcatggaaaggtgactggccattaccagcaaagttacccctagttggtggtcacgaaggtgcgggcattgttgttgcgaaaggttctgcagttaccaactttgagattggcgattatgctggtattaagtggttaaacggttcatgtatgtcatgtgaattctgtgaacaaggtgatgaatctaactgtgaacatgccgatttgagtggttatactcatgatggttctttccaacaatatgccactgctgacgctattcaagctgcaaagatcccaaagggtaccgacttatctgaagttgcgccaattttatgtgctggtgttactgtctataaagctttgaaaactgctgatttaagagcaggtcaatgggttgcgatttctggtgccgctggtggtctaggttctcttgctgtccaatatgcaaaggcaatgggtctaagagttttaggtatcgatggtggtgaaggtaaaaaggaactttttgaacaatgtggtggtgatgtgtttatcgatttcaccagatacccaagagatgcacctgaaaagatggttgctgatattaaggctgcaactaacggtttgggtccacacggtgttatcaatgtctctgtctccccagctgctatctctcaatcatgtgactatgttagagcaactggtaaggttgtccttgtcggtatgccatctggtgctgtctgtaagtctgatgtcttcactcatgttgttaaatccttacaaattaaaggttcttatgttggtaacagagcagataccagagaagctttggaattctttaatgaaggtaaggtcagatctccaatcaaggttgtcccattatctactttacctgaaatttacgaattgatggagcaaggtaagattttaggtagatacgttgttgatacttctaaataa

SEQ ID NO: 108 - protein, 376 aa, Issatchenkia orientalis
MFASTFRSQAVRAARFTRFQSTFAIPEKQMGVIFETHGGPLQYKEIPVPKPKPTEILINVKYSGVCHTDLHAWKGDWPLPAKLPLVGGHEGAGIVVAKGSAVTNFEIGDYAGIKWLNGSCMSCEFCEQGDESNCEHADLSGYTHDGSFQQYATADAIQAAKIPKGTDLSEVAPILCAGVTVYKALKTADLRAGQWVAISGAAGGLGSLAVQYAKAMGLRVLGIDGGEGKKELFEQCGGDVFIDFTRYPRDAPEKMVADIKAATNGLGPHGVINVSVSPAAISQSCDYVRATGKVVLVGMPSGAVCKSDVFTHVVKSLQIKGSYVGNRADTREALEFFNEGKVRSPIKVVPLSTLPEIYELMEQGKILGRYVVDTSK

SEQ ID NO: 109 - DNA, 1134 bp, Issatchenkia orientalis
atgttatccaagaccatcactgctgcattgaggggcaatacaactcgtactgcattcagaatcaatgccattagaagtttagcgatcccagctattccagagacacaaaagggtgttatcttttatgagaacggaggtgaactattttacaaggacattccagttccaaagccaaagccaaatgagattttggtgaatgtcaagtattctggtgtttgtcataccgatttacacgcatggaaaggtgactggcctttggcgaccaagttgccattggttggtggacatgaaggtgccggagttgttgttgctaagggggacaatgtcaccaactttgaaattggcgattatgccggtatcaagtggttgaatggttcatgtatggggtgtgaattttgccaacaaggtgcagagccaaactgtccacaggccgacttgagtggttacacccatgacgggtcctttcaacaatatgccactgccgatgctgttcaggcagccaagattcctcagggcactgatttggctcaagttgcgccaattttatgtgcaggtattactgtctataaggctttaaagactgcagaattaagaccaggtcaatgggttgccatttctggtgctgctggaggtttaggttctcttgctgttcaatatgccaaggccatgggtttgagagttttgggtattgatggtggtgaggagaagggcaagtttgcaaagtctcttggagctgaagttttcattgatttcaccaaatccaaggacattgtcaaggatatccaagaggccaccaatggtggtccacatggtgtcattaatgtttctgtttctccagctgctatttctcaaagtacccagtatgtcagaaccttgggtaaggttgtccttgttggattaccagcgcatgctgtatgcgagtcttcggttttcgaccatgttgtcaagtcgattcaaattagaggctcttatgttggtaacagggaagatactagtgaggctattgattttttcaccaggggtttagtgaagtcaccaattaagattgttggtttgagtgagttgccaaagatctatgaattgatggagcaaggtaagattttaggcagatatgttgttgacacttcgaaatga

SEQ ID NO: 110 - protein, 377 aa, Issatchenkia orientalis
MLSKTITAALRGNTTRTAFRINAIRSLAIPAIPETQKGVIFYENGGELFYKDIPVPKPKPNEILVNVKYSGVCHTDLHAWKGDWPLATKLPLVGGHEGAGVVVAKGDNVTNFEIGDYAGIKWLNGSCMGCEFCQQGAEPNCPQADLSGYTHDGSFQQYATADAVQAAKIPQGTDLAQVAPILCAGITVYKALKTAELRPGQWVAISGAAGGLGSLAVQYAKAMGLRVLGIDGGEEKGKFAKSLGAEVFIDFTKSKDIVKDIQEATNGGPHGVINVSVSPAAISQSTQYVRTLGKVVLVGLPAHAVCESSVFDHVVKSIQIRGSYVGNREDTSEAIDFFTRGLVKSPIKIVGLSELPKIYELMEQGKILGRYVVDTSK

SEQ ID NO: 111 - DNA, 1347 bp, Issatchenkia orientalis
atgtctccttcacaaattaacgttgacaacttatctaattggactgaagaattcaaatctgacgccaagactcaaatcgggggttctgtattgcaacattccaacattgatgaggtcttgattaacagagatgcagaaatcgccaacaagcatatcttcaaccacaagattgaaattgaaggtctacctgtcatggatcagaaggcttctggtagatgttggttgtttgcatcgactaacttgatgcgtgttactgcaatgaagaaatacaatttgaaggaaatcaagctttccccatcgtatttgtttttctatgacaaattggaaagagcaaactatttccttgaacaaatcatcgacactcataaggaaccaatcgattcaagattggttcaatatttcctgaccaatccagttgaagatggtggtcaattcaccatgatggcacaaattgctaccaaatacggtgttgttcctgatcaagtctacccagattctttcaacacaaccacttcgaggattatgaacagattagtcaaccacagattacgttcttatgcaatgactttacgtaacgctctagatgaaggtaaagatgtaatgtccttgaagaatgagatgcaaaaagaaatttatcgtttgctaacaatgttccttggtaacccaccaaagccaaacgaagagtttgtctgggaattcaccgataaagatggtaaatatgaatctattaaaactacaccattaaaatatgcaactgaagttttggatttccatgctccagaatatgtttccttgttaaatgacccaagaaataagtataacaagatggttcaagttgaaagattaggtaatgttgctggtggcgaaccagttgcatacttaaacttagaaattgaaaagttatctcaagctgttgttaacagaatcaaaaataacaaaccagttttctttggtaccgatacacctaaatttatggataaaagtagaggtattatggatatcaatttatgggactatgagttattaggttatgatgtccgtaccatgtcaaagaaggaaagagttgtttttggtgattctttaatgacccacgctatgttgattactgcagtgcacgttgatgaaaatggcaaacctgtcagatacagagtcgaaaacagttggggtaccaagagtggtcaagaaggttattacacaatgacccaagaatattttgaagagtacgtttatcaagtagtcattgaaaagagtgaatttgctgccctaaacctcgatgtttccattctggaggataaagaaccagtcgtcttgccaccttatgaccctatgggtgcacttgctttataa

SEQ ID NO: 112 - protein, 448 aa, Issatchenkia orientalis
MSPSQINVDNLSNWTEEFKSDAKTQIGGSVLQHSNIDEVLINRDAEIANKHIFNHKIEIEGLPVMDQKASGRCWLFASTNLMRVTAMKKYNLKEIKLSPSYLFFYDKLERANYFLEQIIDTHKEPIDSRLVQYFLTNPVEDGGQFTMMAQIATKYGVVPDQVYPDSFNTTTSRIMNRLVNHRLRSYAMTLRNALDEGKDVMSLKNEMQKEIYRLLTMFLGNPPKPNEEFVWEFTDKDGKYESIKTTPLKYATEVLDFHAPEYVSLLNDPRNKYNKMVQVERLGNVAGGEPVAYLNLEIEKLSQAVVNRIKNNKPVFFGTDTPKFMDKSRGIMDINLWDYELLGYDVRTMSKKERVVFGDSLMTHAMLITAVHVDENGKPVRYRVENSWGTKSGQEGYYTMTQEYFEEYVYQVVIEKSEFAALNLDVSILEDKEPVVLPPYDPMGALAL

SEQ ID NO: 113 - DNA, 1737 bp, Issatchenkia orientalis
atgttactcagatcactaaactcttctgctcgttgtgtcaaacaaacaaccagaacaaaggttaggtatctcagccacgtcagtggtgcaagcatggcgaaacctacattgaagaacaactcgagagaatccaacaaatccagaaactatctaattgctgctgtgacagcattggctgtatcaacctcaattggagttgccgtacatgtgaaggaccccttgtataacgatgctaccggcagtgattctccgagaagtatatctgttgacgagtttgtcaagcataattcacaaaacgactgttggattgcaatcaatggcaaggtttatgatttcactgattttattccaaaccatccaggtggggtacctccattagttaatcatgctggttatgatggtactaaactttatgagaaattgcatccaaaaggtacaattgagaaattcttgccaaaggataagtttctgggtgtgttagatggtgaagcgccaaaattggaagcagactatttggtggacgatgatgaacaagagagactggattatttgaacaacttacctcctttgtcatctattcagaatgtttatgatttcgaatacttggccaagaagattttacctaaagatgcctgggcatattattcttgtggtgccgatgatgaaatcacaatgagagaaaaccattatgcttatcaaagagtttatttcagaccaagaatttgtgttgatgtcaaggaagttgatacttcttatgaaatgttaggcactaaaacctctgttcctttttatgtatctgccaccgctttggctaaattaggccatcctgatggtgaatgctcaattgctagaggcgctggtaaggaaggtgtcgttcaaatgatttcgaccctttcctcaatgtcattagatgaaattgccgctgctagaattccaggtgcaacccaatggttccaattatacattaatgaggatagaaatgtcgctaaaggtctggtcaaacatgcagaagacttgggtatgaaggctatctttataactgttgatgctccttctctaggtaacagagaaaaggataaaagattaaagtttgttaatgacaccgatgtcgatttgggtgattccgcagatcgaaacagtggtgcttcaaaggcactatcttcgttcattgatgcttctgtctcttggaatgacgtcaaagcggtcaagtcgtggactaaattgcctgtcttagttaaaggtgttcaaacagttgaagacgttattgaagcttacgatgctggttgtcaaggtgttgttttgtcaaaccacggtggtaggcaactagatactgctcctcctccaatcgaattattagctgaaactgttccaactttgaagagattgggtaaattaagaccagattttgaaattttaattgacggtggtgtcaaaagaggtaccgatattttgaaagcagtcgcaatcggtggccaagatgtcagagtttcagttggtatgggtagacctttcttatatgccaactcttgctatggtgaagcaggtgttagaaaattaattcaaaatctaaaggatgaattagaaatggatatgagattgttgggtgtcactaaaatggaccagctatcttcgaaacatgtcgatactaaacgtttgattggtagagatgcgatcaactatttgtatgataatgtatacagcccaatcgaaaccgttaaattcaacaatgaagattga

SEQ ID NO: 114 - protein, 578 aa, Issatchenkia orientalis
MLLRSLNSSARCVKQTTRTKVRYLSHVSGASMAKPTLKNNSRESNKSRNYLIAAVTALAVSTSIGVAVHVKDPLYNDATGSDSPRSISVDEFVKHNSQNDCWIAINGKVYDFTDFIPNHPGGVPPLVNHAGYDGTKLYEKLHPKGTIEKFLPKDKFLGVLDGEAPKLEADYLVDDDEQERLDYLNNLPPLSSIQNVYDFEYLAKKILPKDAWAYYSCGADDEITMRENHYAYQRVYFRPRICVDVKEVDTSYEMLGTKTSVPFYVSATALAKLGHPDGECSIARGAGKEGVVQMISTLSSMSLDEIAAARIPGATQWFQLYINEDRNVAKGLVKHAEDLGMKAIFITVDAPSLGNREKDKRLKFVNDTDVDLGDSADRNSGASKALSSFIDASVSWNDVKAVKSWTKLPVLVKGVQTVEDVIEAYDAGCQGVVLSNHGGRQLDTAPPPIELLAETVPTLKRLGKLRPDFEILIDGGVKRGTDILKAVAIGGQDVRVSVGMGRPFLYANSCYGEAGVRKLIQNLKDELEMDMRLLGVTKMDQLSSKHVDTKRLIGRDAINYLYDNVYSPIETVKFNNED

SEQ ID NO: 115 - DNA, 1698 bp, Issatchenkia orientalis
  misc_feature (941)..(941): N= A, C, T, or G
  misc_feature (943)..(943): N= A, C, T, or G
atgttaagatcccagttcaaaaacattttgaaaaatgttaacaagaaccattctctaaggagaacttttacttccagcacctcaaaggctggaaaaaatgcttcatacaatgccaagattatatctgcaaccgtggcctcgattgttgcagcagctggctcttatatgttggtccagccttcactagctaatgatgaggcacagtctgctaatccaactaggaagatctctgttgacgaatttgttaaacacaaccatgccgatgattgttggatcactgttaacggtaacgtctatgacttgactgatttcatttcaatgcatccaggtggtactaccccattgattcaaaatgcaggtcacgacgcaactgaaatttacaacaagattcatccaaagggtacaatcgagaacttcttaccaaaggaaaagcaattgggtgttttggatggtgaagctcctaaaatcgaagttgtgcttgacgaaaaggagaaacacagattggagttgttgaatcatctccctgctctttccagaattcaaaacatttatgatttcgaacatattgcttctagagttttgagcgaccaagcatggaactactattcatgtggtgccgaagatgaaatcaccttgagggaaaatcattatgcttaccaaagaatctactttaagccaaaatgttgtgtcaatgttgcagaagttgatacctctcatgaaattttaggtacaaaagcttctgttcctttctacgtttccgcagccgcttctgcaaagttggggcacgaggatggtgaatgttccattgctagaggtgcaggtaaggaaggcgttattcaaatgatttcttccttctcttccaactctttggaggaaattgcagaatccagaattcctggtgcaacacaatggtttcaattatacgttaatgaagacaaggntnttgtgaagaagactttaaaaagggccgaaaacttgggtatgaaggccatctttgtcactgtggacgctgctagtagaggtaatagagaaaaagacattacaatgagaattaccgaagatacagatgagttaatagacgattcttctgttagagctggttctacctctggtgcattgccagctttcattgacaagaggctgacttgggatgaagttaaggatatcatttcatggaccaagttaccagttttgctgaagggtgttcaaagaactgatgatattgagaaggcaattgatattggttgtaagggtgttgtcttgtccaatcatggtggtagacaattagatacttctcctcctccaatagaagttatggctgaatctgttccaatcctaaagcaaaagggtaaactggatccaaatttcagtattttcgttgatggtggtgttagaagaggtacagatattttgaaagctttggctattggtggcagagactgtaaagttgctgttggtctgggtagacctttcctttatgcaaatactggttatggtgaaaagggtgtcagaaaggccgtgcaaattctaagagaagaattaaaggctgacatgagaatgttgggcgttacctctttgaacgagctagacgactcttacattgacaccagaagattactaggtagagatgctgttaaccacatatacaacaacaactactacccaatgtctaagattcaattcaaaaacgaaaaataa

SEQ ID NO: 116 - protein, 565 aa, Issatchenkia orientalis
  MISC_FEATURE (314)..(314): Xaa = Asp, Gly, Ala, or Val
  MISC_FEATURE (315)..(315): Xaa = Ile, Val, Leu, or Phe
MLRSQFKNILKNVNKNHSLRRTFTSSTSKAGKNASYNAKIISATVASIVAAAGSYMLVQPSLANDEAQSANPTRKISVDEFVKHNHADDCWITVNGNVYDLTDFISMHPGGTTPLIQNAGHDATEIYNKIHPKGTIENFLPKEKQLGVLDGEAPKIEVVLDEKEKHRLELLNHLPALSRIQNIYDFEHIASRVLSDQAWNYYSCGAEDEITLRENHYAYQRIYFKPKCCVNVAEVDTSHEILGTKASVPFYVSAAASAKLGHEDGECSIARGAGKEGVIQMISSFSSNSLEEIAESRIPGATQWFQLYVNEDKXXVKKTLKRAENLGMKAIFVTVDAASRGNREKDITMRITEDTDELIDDSSVRAGSTSGALPAFIDKRLTWDEVKDIISWTKLPVLLKGVQRTDDIEKAIDIGCKGVVLSNHGGRQLDTSPPPIEVMAESVPILKQKGKLDPNFSIFVDGGVRRGTDILKALAIGGRDCKVAVGLGRPFLYANTGYGEKGVRKAVQILREELKADMRMLGVTSLNELDDSYIDTRRLLGRDAVNHIYNNNYYPMSKIQFKNEK

SEQ ID NO: 117 - DNA, 1167 bp, Issatchenkia orientalis
atggtgtcccctgctgaaagattatctactattgcgtccacaatcaagccaaacagaaaagattctacatcattacaaccagaagactatccggaacatccgttcaaggtgacggttgttggttccggtaactgggggtgtacaattgccaaggttatagcggaaaacaccgttgagagacctcgtcaatttcaaagagatgttaatatgtgggtctatgaagaattgattgaaggcgaaaagttgactgaaatcataaataccaaacacgaaaacgtcaagtacttgccaggtatcaagttgccagttaacgttgttgcagttccagacattgttgaggcttgtgcaggctcagacttgattgtctttaatattcctcaccaatttttaccaagaattttatcccaattaaagggtaaggtgaatccaaaggctagagcaatttcttgtttgaaaggtttggatgtcaatcctaatggatgtaagttgctctccactgttattactgaagagttgggtatttattgtggtgccttatcaggtgctaatttagctcctgaagttgcacaatgtaaatggtcggaaacaactgttgcatatacaattccggacgatttcagaggtaaaggcaaggatattgaccatcaaattctaaagagtttgttccatagaccttatttccatgttcgtgttattagtgatgttgcaggtatttccattgccggtgcactcaagaatgtcgttgctatggctgctggatttgtcgaaggtttaggttggggtgataatgcaaaggctgcagtcatgagaataggtttggtggaaaccattcaatttgccaagacttttttcgatggctgtcatgctgcaacctttactcatgaatctgcaggtgttgccgacctaatcactacctgtgccggcggccgtaacgttagagttggtagatatatggcacaacattctgtctctgcaacggaggctgaagaaaagttgttgaatggccaatcctgtcaaggtatccacacaactagggaagtttacgagttcctctccaacatgggcaggacagatgagttcccactatttaccaccacctaccgtatcatctacgaaaacttcccaattgagaagctgccagaatgccttgaacctgtggaagattaa

SEQ ID NO: 118 - protein, 388 aa, Issatchenkia orientalis
MVSPAERLSTIASTIKPNRKDSTSLQPEDYPEHPFKVTVVGSGNWGCTIAKVIAENTVERPRQFQRDVNMWVYEELIEGEKLTEIINTKHENVKYLPGIKLPVNVVAVPDIVEACAGSDLIVFNIPHQFLPRILSQLKGKVNPKARAISCLKGLDVNPNGCKLLSTVITEELGIYCGALSGANLAPEVAQCKWSETTVAYTIPDDFRGKGKDIDHQILKSLFHRPYFHVRVISDVAGISIAGALKNVVAMAAGFVEGLGWGDNAKAAVMRIGLVETIQFAKTFFDGCHAATFTHESAGVADLITTCAGGRNVRVGRYMAQHSVSATEAEEKLLNGQSCQGIHTTREVYEFLSNMGRTDEFPLFTTTYRIIYENFPIEKLPECLEPVED

SEQ ID NO: 119 - DNA, 1566 bp, Issatchenkia orientalis
atgttgtccctctctaaacagtcaagaaactttttcaaattgaactatttttcagtcacccaaatagcaaaaatgtctgcaacttccgtcactttcccaattatcaacgaaacttaccaacagccaaccgggcttttcatcaacaatgaatttgttagtgcaaagtcaggtaagacttttgatgttaacaccccaattgatgagtctctcatttgtaaagtccaacaggccgatgctgaagatgttgaaattgccgttcaagcagcatctaaagcttacaagacttggagatttacaccgccaaatgaaagaggcagatacttgaacaaattggccgatttgatggacgaaaagagagacttacttgccaaaattgaatcccttgataatggtaaggccttacattgtgcaaaattcgatgtcaatcttgtcattgaatatttcagatactgtgcaggttactgtgataaaatcgatggtagaacaattacaaccgatgtagaacattttacctacactagaaaggaacctttaggtgtctgtggtgcaattacaccttggaacttcccattgctgatgtttgcttggaaaatcggcccggctttagcaaccggtaataccattatcttgaagcctgccagtgcaacacctctatcaaacctctttacttgtaccttgatcaaggaggcgggcattccagccggtgttgttaatgttgttccaggttccggtagaggctgtggtaactccattttacaacatcctaaaattaagaaggttgcgtttaccggatctacagaagttggtaaaactgttatgaaggaatgtgctaattccatcaaaaaggttactctcgaattgggtggtaagtctccaaacattgttttcaaagactgtaacgttgaacaaaccattcaaaatttgattactggtattttcttcaatggtggtgaagtctgttgtgctggttctagaatttacattgaagcaaccgatgagaaatggtatactgaattcttgaccaaattcaaggagactgttgaaaaattaaagattggtaacccatttgaagagggtgttttccaaggtgcacaaaccactccagatcaattccaaactgtcttggactacatcaccgctgctaacgaatccagcttgaaactattaactggtggtaaaagaattggcaataagggatactttgttgagccaactatcttctacgatgttcctcaaaattccaagttaactcaagaagaaatctttggtccagttgctgttgttttacctttcaagtccactgaagaattgattgaaaaggcaaatgattccgattttggcttaggttccggtattcacactgaagatttcaacaaggcaatttgggtttccgaaaggcttgaagcaggttctgtttggatcaacacttacaatgatttccacccagctgctccattcggtggttacaaggaatccggtattggcagagaaatgggtattgaagctttcgacaactatactcaaaccaagttagttagagctagagttaacaagccagctttttag

SEQ ID NO: 120 - protein, 521 aa, Issatchenkia orientalis
MLSLSKQSRNFFKLNYFSVTQIAKMSATSVTFPIINETYQQPTGLFINNEFVSAKSGKTFDVNTPIDESLICKVQQADAEDVEIAVQAASKAYKTWRFTPPNERGRYLNKLADLMDEKRDLLAKIESLDNGKALHCAKFDVNLVIEYFRYCAGYCDKIDGRTITTDVEHFTYTRKEPLGVCGAITPWNFPLLMFAWKIGPALATGNTIILKPASATPLSNLFTCTLIKEAGIPAGVVNVVPGSGRGCGNSILQHPKIKKVAFTGSTEVGKTVMKECANSIKKVTLELGGKSPNIVFKDCNVEQTIQNLITGIFFNGGEVCCAGSRIYIEATDEKWYTEFLTKFKETVEKLKIGNPFEEGVFQGAQTTPDQFQTVLDYITAANESSLKLLTGGKRIGNKGYFVEPTIFYDVPQNSKLTQEEIFGPVAVVLPFKSTEELIEKANDSDFGLGSGIHTEDFNKAIWVSERLEAGSVWINTYNDFHPAAPFGGYKESGIGREMGIEAFDNYTQTKLVRARVNKPAF

SEQ ID NO: 121 - DNA, 1506 bp, Issatchenkia orientalis
atgtcagcactgttcagaaccattgagactccaaacggtaaaaccctggaacaaccactgggtctcttcatcgacaatgagtgggtgaaaacaaaccgtacttttgagaccattaatccgtccacaggtgaggcgatctgtcatgtttaccgtgctggggtccaggaggtgaacgacgctgtcgaagctgcaaatagagcatttagaaacgaatcttggtcaggtctaactggttctcaacgtggcgatttactgtatcgcatgtaccaagttatcaaaagagacgccgagagcattgcatcgattgagtccatggataatggtaaaccgtatgctgcagaatgcctagatggagatttaggtgaagctgctgacgttttcaaatattatgccggttgggccgacaagatcaccggtgaactcattggctcgagtgtattgggtaagaataagatgtgttatgtcgagcctacaccactgggtgccgttggcggtatagtcccttggaatttcccgtttaccatgatggcatggaaaattgccccggcactggcgacgggttgtacagtggttatgaagtcaagtgaagtcacaccgttgacggcattatggtatggcaagattgcacttgaagtgggtctacctaaaggtgtacttaacatcctctccggttttggatcggatgttggatcggccatggcttcacatccaaagttggctaagatagcgttcactggctcaactgcaactggtaaaaaaatcatggaagcagcaggtggttccaacttgaaaaaggttacactagagtgtggtggtaaatctccttacattgtttttgatgatgctgacttagaattggcagtagaatgggcatattggggtatttggtataacaaaggtgaggtttgtacttcaacttcgagatttttgattcaggaagacatttacgataagtttgttgagagttttgttgagttgaccaagacgagagcaatcactgctgatccgtttgatgatagatgcactatcgggcctttggtttctagctcacagtacgaaaaagtcaaaaagtacgttgaaataggtaaaaatgaaggagcaaagctactaactggcaaattcatcgacgggccaggctatttctgtgagccatttatcttcagtgaatgcactgacgatatgacaatcatgaaagaggaaatctttggccctgttgtggggattactaaattctcaacggttaaagaggcgatcgagagagccaatgctacgacttacggtttaggagctgcgttgttttcctctaacataacaaaggcacattctgtggctgccaagttggaggctggaatggtgtggatcaattctaatggtgattctgatatccacattccatttggtggttccaaaatgagtggtataggtagggagttggggccatacgcactagacttgtttactgagaaaaaggcagttcatgtcaacttatcgcttccggtcaagtga

SEQ ID NO: 122 - protein, 501 aa, Issatchenkia orientalis
MSALFRTIETPNGKTLEQPLGLFIDNEWVKTNRTFETINPSTGEAICHVYRAGVQEVNDAVEAANRAFRNESWSGLTGSQRGDLLYRMYQVIKRDAESIASIESMDNGKPYAAECLDGDLGEAADVFKYYAGWADKITGELIGSSVLGKNKMCYVEPTPLGAVGGIVPWNFPFTMMAWKIAPALATGCTVVMKSSEVTPLTALWYGKIALEVGLPKGVLNILSGFGSDVGSAMASHPKLAKIAFTGSTATGKKIMEAAGGSNLKKVTLECGGKSPYIVFDDADLELAVEWAYWGIWYNKGEVCTSTSRFLIQEDIYDKFVESFVELTKTRAITADPFDDRCTIGPLVSSSQYEKVKKYVEIGKNEGAKLLTGKFIDGPGYFCEPFIFSECTDDMTIMKEEIFGPVVGITKFSTVKEAIERANATTYGLGAALFSSNITKAHSVAAKLEAGMVWINSNGDSDIHIPFGGSKMSGIGRELGPYALDLFTEKKAVHVNLSLPVK

SEQ ID NO: 123 - DNA, 1506 bp, Issatchenkia orientalis
atggctcttccacttgcaactacaatctccttatcaagcggcaaaacattagaacagccaattggtttatttattgataatgaatttgtcaatccaatttctgtttctaatgcaagaacactaacaaccttcaacccaagcacaggtgagccaataaccgatgttcattgtgcctcagctgcagatgttgatgttgcggtaaatgctgcaaacaaggcaatggaaacatggaaagacattgatcctactgttcgtgtcgaacttttactaaaattggccagcttagttgacgagcattcccaagcaattgctgaaattgaagcactagactcgggtaaaccattgtactcgaatgcactggcggatgttcaatcggttgctgagtacttaaggtactgtgccggttgggcggataaattacacggtacgcaaattccaataaactctaaggtaatggctattacaaaacgtgtacccttagttgtcggctgcatcattccatggaactacccaatttcaatggcctcctggaagttctgtccagcattggctgccggatgtactattgtaatgaagtcaagtgagataaccccgttatcgttactttattttgcgaatttggtcaaattagcaggtttccctaagggtgtttttaatgtcgtctctggatttggtgatgatgttggctcagcgctttcaaatcacccaaagttgggtaagattgcatttacaggctcgaccttgaccgggcaaaaggtgatggcggatgctgccagatcaaatttgaaaagcgtatctttggaatgtggtggtaaatctccacttattgtcttcgaagatgcagaattggatgaatgcgttaaatgggcaagttttggtgtcatgtataacaccggacaaaattgtactgccaattctcgtattattgtgcatgataaggtttatgatcaatttatcgaaaagttcctgtctcaactcaaggaagattggaaaatgggagatgtcatgaatgaaaagactacattgggaccacttgtcagccaacaacaatatgagcgtgttcagtcgtatattgatataggtgtcaaagaaggggctacactgattcaaccgcttaaggagagcactccatcaaatggattctacatctctcctactgtttttactaacgttaaggaagatatgagaattgttaaggaggaaatatttggtcctgtcgtaactatctccaaattctcaactgaggaagaggcaatttcaaaggcgaatgatacaatttatggcttagctgcaatgttatttactactaattttgaacgtgccaacagagttgctgataagctggaagctggcagtgtgtacattaatagctctaacaacgagagtaccaaagttccatttggaggaatgaagatgagtggtattggaagagagttggggcaagaagcatttaatttgtacactgttacaaagagtatttattatagttatggtgctaagctttaa

SEQ ID NO: 124 - protein, 501 aa, Issatchenkia orientalis
MALPLATTISLSSGKTLEQPIGLFIDNEFVNPISVSNARTLTTFNPSTGEPITDVHCASAADVDVAVNAANKAMETWKDIDPTVRVELLLKLASLVDEHSQAIAEIEALDSGKPLYSNALADVQSVAEYLRYCAGWADKLHGTQIPINSKVMAITKRVPLVVGCIIPWNYPISMASWKFCPALAAGCTIVMKSSEITPLSLLYFANLVKLAGFPKGVFNVVSGFGDDVGSALSNHPKLGKIAFTGSTLTGQKVMADAARSNLKSVSLECGGKSPLIVFEDAELDECVKWASFGVMYNTGQNCTANSRIIVHDKVYDQFIEKFLSQLKEDWKMGDVMNEKTTLGPLVSQQQYERVQSYIDIGVKEGATLIQPLKESTPSNGFYISPTVFTNVKEDMRIVKEEIFGPVVTISKFSTEEEAISKANDTIYGLAAMLFTTNFERANRVADKLEAGSVYINSSNNESTKVPFGGMKMSGIGRELGQEAFNLYTVTKSIYYSYGAKL

SEQ ID NO: 125 - DNA, 1544 bp, Issatchenkia orientalis
  misc_feature (1319)..(1319): N= A, C, G, OR T
atgatgggcgcaactacagcaaaaattagtattccaaatggtaacaaatacgagcaacctacaggtttgttcatcaatggtgagtttgttgcttcaagtgatggtaaaactgcagaagttgagaatccaggcaatggaaacattgtatgttctgtccacttagcttctattgaggatattaataccgccgtagaagctgctgaagatgcatttttcaaaaggtgggccaccatcagtggtaaagccaagggagaatacttgagtaagattgccgatctaatcgttaaatattctgatcaattggcagatctagaggctattgaatcaggtaagccaaaggacaccaatgcaatctttgatgttttacattcggctgatgttttcagatactatgctggcaaggctgtcactgcacaaagcggcaagactatcgagtccgaactctccaaatttacatacacagtttacgagccctatggtgtttgtgccgctatcatcgcatggaacttcccaatgagcacatttgcgtggaaagttgcggcatgtttagctgctggtaatacaatggttgtcaaaacttccgagctgactccgttatctgcattgttcatgtgtaagattttccaagaagcagatctacctgctggagttataaacgtcacatgtggtttaggttctgttgcaggtgttcgattgagtgaacatgaaaaggttcagaaaatttcgtttactggctccactggcgttggtaagttgatccaagaatccgcagcaaagtctaacttaaagtattgtacgcttgaatgtggtggtaagtctccgttagtgatttacgaggatgcagatcttgagcaagcagtgaagtgggctgcctttggtatttttttcaacaaaggtgaaatttgcacagcctcttccagaatatatgttcaagaatcagtctatgacaaatttttgactatgtacaaggatcatgtggaagaagcctatgttcaaggagaacagtttgccactggtgttaacgttgggcctactgtctgcaaagcccaacaagagaaaatactggcctacattgaaagtgccaagcaagaaggtggtagaattatcactggtggtaaaataccatcttacacgaacaaaaatggttactatctcgaaccaacaattattgcagattgtaaccaggatatgaaggtagtcagggaagagattttcggaccagtcgttactgtatccaaattcactagtgatgaagaagccatcaaattaagcaatgattccgaatatggcttggcagcatatttattcactystsrasnassrgttyrgytaaaatyrththraaggacctcgttagatctcagaattatatcagaaaagtgcaaagcggacaggtctttgtcaacttcacctttgcggctgatttcaggttgccatttggcggatataagatgagtggtaacggaagagagcttggtgatgaaggactgagtgctttccagcaagtcaaagcagtacacattaatctcactgggaagttgtaa

SEQ ID NO: 126 - protein, 503 aa, Issatchenkia orientalis
MMGATTAKISIPNGNKYEQPTGLFINGEFVASSDGKTAEVENPGNGNIVCSVHLASIEDINTAVEAAEDAFFKRWATISGKAKGEYLSKIADLIVKYSDQLADLEAIESGKPKDTNAIFDVLHSADVFRYYAGKAVTAQSGKTIESELSKFTYTVYEPYGVCAAIIAWNFPMSTFAWKVAACLAAGNTMVVKTSELTPLSALFMCKIFQEADLPAGVINVTCGLGSVAGVRLSEHEKVQKISFTGSTGVGKLIQESAAKSNLKYCTLECGGKSPLVIYEDADLEQAVKWAAFGIFFNKGEICTASSRIYVQESVYDKFLTMYKDHVEEAYVQGEQFATGVNVGPTVCKAQQEKILAYIESAKQEGGRIITGGKIPSYTNKNGYYLEPTIIADCNQDMKVVREEIFGPVVTVSKFTSDEEAIKLSNDSEYGLAAYLFTKDLVRSQNYIRKVQSGQVFVNFTFAADFRLPFGGYKMSGNGRELGDEGLSAFQQVKAVHINLTGKL

SEQ ID NO: 127 - DNA, 1716 bp, Issatchenkia orientalis
  misc_feature (655)..(655): n is a, c, g, or t
atggctccaactgctgttgatatccataacgagtacaaacagaatgtttccaacgaacaggaaattcctttcaacaaaactgaaagaaagtcatcgattgcatctaaattaggactgaatccagacgctaagattcactacaattctgctgttcctatattatacgaagatggtttaaaggaaaaaggtacaaccatttcctcttctggtgcattgattgcattctctggttccaaaacaggtagatctccaaaggacaaaagaattgtcgatgaagagacttcaacagacaacatctggtggggtccagtcaataagaaggttgatgaaaacacttggaatatctcgaaatctagagcgattgattatttgagaacaagagagaaggtttacattatcgatgcttttgctggttgggatccaagatacagaattaaggttagaattgtctgtgctagagcttaccatgctttgttcatgaagaatatgttaattagaccaacaacggaagaattaaagaactttggtgagcctgatttcaccatttggaatgcaggtcaattccctgctaatgtttacactaagggtatgacttcttcaacttctgttgaaataaatttcaagtctthrysgymtthrsrsrthrsrvagtasnhyssratggaaatggttatcctaggtactgaatacgcaggtgaaatgaagaaaggtatctttaccgttatgttctacttgatgccaatcagacacaaggttttaactttacactcttctgcaaatcaaggtaaaaaggatggtgatgtcacattattctttggtttatctggtacaggtaaaacaaccttgtctgcagatcctcatagagaattgattggtgatgatgaacattgctggtctgatcatggtgttttcaacattgaaggtggatgttatgctaagtgtttggacttatctgctgaaagagaacctgagattttcaatgcaattaggtttggatctgtcttggagaatgttgtctatgatccagttgatagaactgttgactattccgctgctaatgtcactgaaaatactagatgtgcttatcctatcgactttattccttctgctaagatcccatgtctggcagattctcatccaaagaatattgttcttttaacttgtgatgcaagaggtgttttgccacctgtctccaagctaactaatgcacaagtcatgtatcactttatctctggttacacctccaagatggcaggtaccgaagttggtgtcactgaaccagaagcaaccttctctgcatgttttggtcaacctttcttagttttacatccaatgaaatacgcacaacaactctctgataaaatggctgaacattcttccaccgcttggttattgaataccggttggactggtcaatcttatgttaaaggtggtaagagatgtccattgaagtatactagagcaattttagatgctattcactctggtgagcttgcaaaacaggaattcgaaacataccctactttcggtttacaagttccaaaaacttgtccaggtgtcccagaaagtgttctgaacccatctaaacactgggctactggtgaagctgatttcaaggctgaagtcactaacttggctaaattatttgctgagaactttgaaaagtattctgcagaatgtactgcagaagttgttgctgctggtcctgctttataa

SEQ ID NO: 128 - protein, 560 aa, Issatchenkia orientalis
MAPTAVDIHNEYKQNVSNEQEIPFNKTERKSSIASKLGLNPDAKIHYNSAVPILYEDGLKEKGTTISSSGALIAFSGSKTGRSPKDKRIVDEETSTDNIWWGPVNKKVDENTWNISKSRAIDYLRTREKVYIIDAFAGWDPRYRIKVRIVCARAYHALFMKNMLIRPTTEELKNFGEPDFTIWNAGQFPANVYTKGMTSSTSVEINFKSMEMVILGTEYAGEMKKGIFTVMFYLMPIRHKVLTLHSSANQGKKDGDVTLFFGLSGTGKTTLSADPHRELIGDDEHCWSDHGVFNIEGGCYAKCLDLSAEREPEIFNAIRFGSVLENVVYDPVDRTVDYSAANVTENTRCAYPIDFIPSAKIPCLADSHPKNIVLLTCDARGVLPPVSKLTNAQVMYHFISGYTSKMAGTEVGVTEPEATFSACFGQPFLVLHPMKYAQQLSDKMAEHSSTAWLLNTGWTGQSYVKGGKRCPLKYTRAILDAIHSGELAKQEFETYPTFGLQVPKTCPGVPESVLNPSKHWATGEADFKAEVTNLAKLFAENFEKYSAECTAEVVAAGPAL

SEQ ID NO: 129 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 130 - DNA, 420 bp, Streptomyces avermitilis
atgttaagaaccatgttcaaatctaagattcacagagcaactgttactcaagcagatctccattatgttggttccgttactattgatgcagacttgttagacgcagcagacttgttgccaggtgaattggttcacatcgttgacattacgaacggtgctagattggaaacttacgtcattgaaggtgaacgtggttccggtgttgttggtatcaatggtgctgccgctcatttagttcatcctggtgatcttgttatcattatctcctatgcacaagtttcagatgcagaagcacgtgcattgcgtccaagagttgttcacgttgacagagacaatagagttgttgcgcttggtgcggatccagccgaaccagtcccaggttccgaccaagctagatccccacaagctgttactgcataa

SEQ ID NO: 131 - DNA, 384 bp, Clostridium acetobutylicum
atgcacttgaacatgttgaagtccaagatccacagagctaccgtcgttcaagcagacttgaactacgtcggttccatcaccatcgacagaaacttgatggacaaggcaaacatcttggaatacgaaaaggtcgagatcgcaaacatcaacaacggtgcaagattcgaaacctacgtcatcgctggtgaggctggttccggtatcatctgtttgaacggtgctgctgcaagatgtgcacaagcgggtgacaaggttatcatcatgtgttactgttccttgaccccagaagaagcttccgagcacagaccaaaggtcgttttcgtcaacgacgacaactccatctccaacgtcaccgaatacgagaagcacggcaccatcggttaa

SEQ ID NO: 132 - DNA, 354 bp, Helicobacter pylori
atgaccttcgagatgttgtactccaagatccacagagcaaccatcaccgacgcaaacttgaactacatcggctccatcaccatcgacgaggacttggctaagttggctaagttgagagagggtatgaaggtcgaaatcgtcgacgtcaacaacggcgagagattctccacctacgtcatcttgggtaagaagagaggtgaaatctgcgtcaacggtgcagcagccagaaaggtcgctatcggtgacgtcgtcatcatcttggcttacgcatccatgaacgaggacgagatcaacgctcacaagccatccatcgtcttggtcgacgaaaagaacgaaatcttggaaaagggttaa

SEQ ID NO: 133 - protein, 117 aa, Helicobacter pylori
MTFEMLYSKIHRATITDANLNYIGSITIDEDLAKLAKLREGMKVEIVDVNNGERFSTYVILGKKRGEICVNGAAARKVAIGDVVIILAYASMNEDEINAHKPSIVLVDEKNEILEKG

SEQ ID NO: 134 - DNA, 387 bp, Bacillus sp. TS25
atgtacagaaccatgatgaagtccaagttgcacagagcgaccgtcaccgaagcaaacttgaactacgtcggttccatcaccatcgaccaagacttgatggaagctgcagacatcttggaaaacgagaaggtccaaatcgtcaacaacaacaacggtgctagattcgaaacctacgtcatcgctggtccaagaggctccggcaccatctgtttgaacggtgcagcagcaagattggtccaaccaggtgacaccgttatcatcatctcctacgcaatgttggaagaagccgaggctagaaagcaccaacctgtcgtcgttttgttgaacccagacaacaccatccaagaattgatcagagaaacccacggtgctaccgctaccgtctaa

SEQ ID NO: 135 - protein, 128 aa, Bacillus sp. TS25
MYRTMMKSKLHRATVTEANLNYVGSITIDQDLMEAADILENEKVQIVNNNNGARFETYVIAGPRGSGTICLNGAAARLVQPGDTVIIISYAMLEEAEARKHQPVVVLLNPDNTIQELIRETHGATATV

SEQ ID NO: 136 - DNA, 411 bp, Corynebacterium glutamicum
atgttgagaaccatcttgggttccaaaatccacagagctaccgttacccaagcagacttggactacgttggttcagtcaccatcgatgcagacttggttcatgccgcaggtttgatcgaaggtgaaaaggttgccatcgtcgacatcaccaatggcgctagattggaaacctacgttatcgttggtgatgctggcaccggtaacatctgtatcaacggtgcagcagcacacttgatcaacccaggtgatttggttatcatcatgtcctacttgcaagctaccgatgcagaggccaaggcttacgaaccaaagatcgttcacgtcgacgcagacaacagaatcgttgctttgggtaacgacttggcagaagctttgcctggttccggtttgttgacctcaagatctatctaa

SEQ ID NO: 137 - protein, 136 aa, Corynebacterium glutamicum
MLRTILGSKIHRATVTQADLDYVGSVTIDADLVHAAGLIEGEKVAIVDITNGARLETYVIVGDAGTGNICINGAAAHLINPGDLVIIMSYLQATDAEAKAYEPKIVHVDADNRIVALGNDLAEALPGSGLLTSRSI

SEQ ID NO: 138 - DNA, 384 bp, Bacillus licheniformis
atgtacagaaccttgatgtccgctaagttgcacagagctagagtcaccgaagcaaacttgaactacgttggttccgtcaccatcgacgaggacttgttggacgcagtcggtatgatggcaaacgaaaaggtccaaatcgtcaacaacaacaacggtgctagattggaaacctacatcatccctggtgagagaggttccggtgtcgtctgtttgaacggtgctgcagctagattggtccaagttggtgacgtcgttatcatcgtttcctacgccatgatgtccgaagaagaagcaaagacccacaagccaaaggtcgctgttttgaacgaaagaaacgaaatcgaagagatgttgggtcaagaaccagctagaaccatcttgtaa

SEQ ID NO: 139 - protein, 127 aa, Bacillus licheniformis
MYRTLMSAKLHRARVTEANLNYVGSVTIDEDLLDAVGMMANEKVQIVNNNNGARLETYIIPGERGSGVVCLNGAAARLVQVGDVVIIVSYAMMSEEEAKTHKPKVAVLNERNEIEEMLGQEPARTIL

SEQ ID NO: 140 - DNA, 1356 bp, Streptomyces avermitilis
atgacaccacagccaaacccacaagtcggtgcagcagtcaaagctgcagatagagcacacgtcttccactcttggtctgcacaagaattgatcgatccattggctgttgctggtgcagagggttcctacttctgggattacgatggtagacgttaccttgacttcacctccggcttagtcttcaccaacatcggttaccaacacccaaaggttgtcgcagctatccaagaacaagccgcatctttgactacatttgccccagctttcgcagttgaagcaagatccgaagctgcaagattgatcgctgagcgtactccaggtgatttagacaaaatcttcttcaccaacggtggcgcagatgctatcgagcacgctgttcgtatggcaagaatccacgctggtagaccaaaggtcttatccgcatacagatcataccacggtggtacacaacaggcagtcaacatcactggtgatccaaggagatgggcatccgattccgcttctgctggcgttgtccacttctgggctccatacttatacagatccagattctacgccgaaactgagcaacaagaatgtgagcgtgctcttgagcacttggaaactactatcgccttcgaaggtccaggtactattgccgctatcgttttggaaactgtcccaggtactgctggtatcatggttcctccaccaggttacttagcaggtgttagagaattgtgtgacaaatacggtatcgtcttcgtcttggatgaagtcatggctggtttcggcagaactggcgaatggttcgctgcagacttattcgatgttaccccagacttgatgaccttcgctaagggtgtcaactcaggttacgttccattgggtggtgttgctatctccggcaaaatcgcagagactttcggtaagagagcttacccaggtggtttgacgtactccggtcaccctcttgcttgcgcagccgctgttgctactatcaacgttatggcagaagaaggtgtcgttgaaaacgctgcaaacttgggtgctagagttatcgaaccaggtttgagagaacttgcagagagacacccatcagttggtgaagttagaggtgttggtatgttctgggctttggaattggttaaggatagagaaaccagagaacctttggtcccatacaatgccgctggtgaagcgaacgcaccaatggctgctttcggtgcagctgcaaaggcaaacggtttgtggccattcatcaacatgaacagaacccacgttgttcctccttgtaacgttaccgaagccgaagctaaagaaggcttggcagcattggatgcagctttatctgttgcagatgagtacactgtctaa

SEQ ID NO: 141 - DNA, 1416 bp, Saccharomyces cerevisiae
atgtccatctgtgagcaatactacccagaagaaccaaccaagccaaccgtcaagaccgaatccatccctggtccagaatcccaaaagcaattgaaggaattgggtgaagttttcgacaccagaccagcttacttcttggcagactacgaaaagtccttgggtaactacatcaccgacgtcgacggtaacacctacttggacttgtacgctcaaatctcctccatcgccttgggttacaacaacccagcattgatcaaagccgctcaatccccagaaatgatcagagcattggttgacagaccagccttgggtaacttcccttccaaggacttggacaagatcttgaagcaaatcttgaagtccgctccaaagggtcaggaccacgtctggtccggtttgtccggtgcagacgcaaacgaattggctttcaaggctgcattcatctactacagagctaagcaaagaggttacgacgcagacttctccgaaaaggaaaacttgtccgttatggacaacgacgcaccaggtgctccacacttggcagttttgtccttcaagagagctttccacggtagattgttcgcatccggttccactacctgttccaagccaatccacaagttggacttccctgctttccactggccacacgccgaatacccatcctaccagtaccctttggacgaaaactccgacgcaaacagaaaggaggacgaccactgcttggcaatcgttgaagaattgatcaagacctggtccatccctgttgctgcgttgatcatcgaaccaatccaatccgagggtggtgacaaccacgcctccaagtacttcttgcaaaagttgagagacatcaccttgaagtacaacgtcgtctacatcatcgacgaagtccaaactggcgttggcgcaaccggtaagttgtggtgtcacgaatacgcagacatccagcctccagtcgacttggtcaccttctccaagaagttccaatccgctggctacttcttccacgaccctaagttcatcccaaacaagccatacagacaattcaacacctggtgtggtgaaccagcaagaatgatcatcgcaggtgcaatcggtcaagagatctccgacaagaagttgaccgaacaatgctccagagtcggtgactacttgttcaagaagttggaaggtttgcaaaagaagtacccagagaacttccaaaacttgagaggtaagggtagaggcaccttcatcgcttgggacttgccaactggcgagaagagagacttgttgttgaagaagttgaagttgaacggctgtaacgttggtggctgtgctgttcacgcagtcagattgagaccttccttgaccttcgaagagaagcacgcagacatcttcatcgaagctttggctaagtccgtcaacgaattgtaa

SEQ ID NO: 142 - DNA, 1428 bp, Saccharomyces kluyveri
atgccatcctactccgttgcagaattgtactacccagacgaacctaccgaacctaagatctccacctcctcctacccaggtccaaaggcaaagcaagaattggaaaagttgtccaacgtcttcgacaccagagcagcttacttgttggcagactactacaagtcccgtggtaactacatcgttgaccaggacggtaacgtcttgttggacgtttacgctcaaatctcctccatcgccttgggttacaacaacccagaaatcttgaaggttgcaaagtccgacgcaatgtccgttgcattggccaaccgtccagcattggcttgtttcccatccaacgactacggtcaattgttggaagacggtttgttgaaggcagcaccacaaggtcaagacaagatctggaccgctttgtccggttccgacgcaaacgaaaccgccttcaaagcctgcttcatgtaccaagctgcgaagaagagaaacggtagatccttctccaccgaagaattggaatccgttatggacaaccaattgccaggcacctccgaaatggttatctgttccttcgaaaagggtttccacggtcgtttgttcggttccttgtccactaccagatccaagcctatccacaagttggacatcccagctttcaactggcctaaagccccattcccagacttgaagtacccattggaagaaaacaaggaagccaacaaggctgaagaatcctcctgtatcgaaaagttctcccaaatcgttcaagagtggcaaggtaagatcgctgcagttatcatcgaaccaatccagtccgagggtggcgacaaccacgcttcctccgacttcttccaaaagttgagagaaatcaccatcgaaaacggtatcttgatgatcgtcgacgaagttcaaaccggtgtcggtgctaccggcaagatgtgggcacacgaacactggaacttgtccaaccctccagacttggttaccttctccaagaagttccaagcagcaggtttctactaccacgacccaaagttgcaaccagaccagccattcagacagttcaacacctggtgtggtgacccatccaaggctttgatcgccaaggttatctacgaagaaatcgttaagcacgacttggtcaccagaactgccgaagtcggtaactacttgttcaacagattggaaaagttgttcgaaggtaagaactacatccagaacttgagaggtaagggtcaaggcacctacatcgctttcgacttcggcacctcctccgagagagactccttcttgtccagattgagatgtaacggtgcaaacgtcgctggttgcggtgactccgctgtcagattgagaccatccttgaccttcgaagagaagcacgcagacgtcttggtttccatcttcgacaagaccttgagacaattgtacggctaa

SEQ ID NO: 143 - DNA, 747 bp, Escherichia coli
atgatcgttttggtcaccggtgcaaccgcaggtttcggcgaatgtatcaccagaagattcatccagcagggtcacaaggttatcgctaccggtagaagacaagagagattgcaagaattgaaggacgagttgggtgacaacttgtacatcgctcaattggacgttagaaacagagcagctatcgaagaaatgttggcatccttgccagctgaatggtgcaacatcgacatcttggtcaacaacgctggtttggcattgggtatggaaccagctcacaaggctagtgttgaggactgggagaccatgatcgacaccaacaacaagggtttggtctacatgaccagagcagttttgcctggtatggttgaaagaaaccacggtcacatcatcaacatcggttccaccgctggttcctggccatacgctggcggtaacgtctacggtgctaccaaggctttcgttagacagttctccttgaacttgagaaccgacttgcacggcaccgctgttagagttaccgacatcgaaccaggtttggttggtggcaccgaattctccaacgtcagattcaagggcgacgacggtaaggctgaaaagacctaccaaaacaccgtcgctttgaccccagaagacgtttcagaggctgtttggtgggtcagtaccttgccagcacacgtcaacatcaacaccttggaaatgatgccagtcacccaatcctacgcaggtttgaacgttcacagacaataa

SEQ ID NO: 144 - DNA, 804 bp, Saccharomyces cerevisiae
atgtcccaaggtagaaaggcagcagaaagattggcaaagaagaccgtcttgatcaccggtgcgtccgctggtatcggtaaggctaccgcgttggagtacttggaagcatccaacggtgacatgaagttgatcttggcagcaagaagattggagaagttggaagaattgaagaagaccatcgaccaagaattcccaaacgctaaggtccacgttgcacaattggacatcacccaagcagagaagatcaagccattcatcgaaaacttgccacaagaattcaaggacatcgacatcttggtcaacaacgctggtaaggcgttgggttccgacagagttggtcaaatcgcaaccgaagacatccaagacgtcttcgacaccaacgtcaccgctttgatcaacatcacccaagctgttttgccaatcttccaagcgaagaactccggtgacatcgtcaacttgggttccatcgctggtagagacgcatacccaaccggctccatctactgcgcctccaagttcgctgtcggtgctttcaccgactccttgagaaaggaattgatcaacaccaagatcagagtcatcttgattgcccctggtttggtcgaaaccgaattctccttggttagatacagaggtaacgaagaacaagcaaagaacgtttacaaggacactaccccattgatggccgacgacgttgcagacttgatcgtttacgctacctccagaaagcaaaacaccgttatcgcagacaccttgatcttcccaaccaaccaagcatccccacaccacatcttcagaggttaa

SEQ ID NO: 145 - DNA, 420 bp, Streptomyces avermitilis
atgcttagaaccatgttcaaatccaagatccacagagcaaccgtcactcaagcagatttgcattacgttggttctgttactattgacgcagacttacttgatgcagccgatttacttcctggtgagcttgttcatattgttgatatcaccaatggtgcgcgtcttgaaacctatgtcattgagggtgaacgtggttccggtgtcgtcggtatcaatggcgcagctgcacacctcgtccatccaggtgacctggtcatcatcatttcttatgcacaggtctccgatgctgaagcccgtgccttaagaccaagagtcgttcacgtcgacagagataacagagttgtcgctttaggtgcagacccagcagagccagttccaggttccgatcaagctagatcaccacaggctgttaccgcctaa

SEQ ID NO: 146 - DNA, 420 bp, Streptomyces avermitilis
atgttaagaactatgtttaagtccaagattcacagagctaccgtcacccaagcagatttgcattacgtcggttccgttaccattgatgcagatttactcgatgcggcagacttgttacctggtgaactagttcacattgttgacattaccaatggtgctagattggaaacttacgtcattgaaggtgaaagaggtagtggtgtcgttggtatcaatggtgcagctgctcacttagttcacccaggtgacttagtcatcatcatttcatatgcacaagtttccgatgcggaagctagagcattaagaccaagagttgttcatgttgatagagacaacagagtcgttgcacttggtgcagatcctgctgaaccagttccaggttcagatcaagctaggtctccacaagcagttactgcataa

SEQ ID NO: 147 - DNA, 420 bp, Streptomyces avermitilis
atgttaagaactatgttcaagagtaagattcatagggctaccgttacccaggcagatctacattatgttggttctgttaccattgacgcagatttgttggatgcagcagacttgttaccaggtgaactcgttcacattgtcgatatcaccaacggtgccagactggaaacttatgtcattgaaggtgagagaggcagtggtgttgtcggcattaacggtgccgcagcacacttggttcatccaggtgacttggtcatcatcatttcttacgcacaagtctccgatgccgaagctagagcattgagacctagagtcgttcacgttgacagagacaatagagttgttgctcttggtgcagatccagctgagccagttccaggttccgatcaagcgagatctcctcaagctgttactgcataa

SEQ ID NO: 148 - DNA, 384 bp, Bacillus licheniformis
atgtatagaaccttgatgagtgcaaagcttcacagagcaagagtcactgaagcaaacttgaactacgttggttctgttactattgacgaagacttacttgatgcagtcggtatgatggcaaacgagaaagttcaaattgtcaacaataacaatggtgcgcgtcttgaaacctatatcattcctggtgaacgtggttccggtgtcgtctgcttgaatggcgcagctgcaaggctcgtccaagttggtgacgtcgtcatcattgtttcttatgcaatgatgtccgaagaagaagccaaaacacataagccaaaggtcgctgtcctcaatgaaagaaacgaaattgaggaaatgttaggtcaggaaccagcgagaaccatcttataa

SEQ ID NO: 149 - DNA, 384 bp, Bacillus licheniformis; identical to SEQ ID NO: 148

SEQ ID NO: 150 - DNA, 384 bp, Bacillus licheniformis
atgtacagaacgttaatgtctgccaagttacacagagcgagagttactgaagcaaatctcaactatgttggttcagttaccattgatgaggatctattggatgctgttggtatgatggcaaatgaaaaggttcaaatcgtcaataacaacaatggtgctagattagaaacttacatcattcctggtgaaagaggttcaggtgttgtttgcttaaacggtgctgccgcaagattagttcaagtcggtgatgttgttatcatcgtctcttatgctatgatgagtgaggaagaagctaagactcataagcctaaggttgccgttctcaatgagagaaacgaaatcgaagaaatgcttggccaagaacctgccagaaccatcctgtaa

SEQ ID NO: 151 - DNA, 384 bp, Bacillus licheniformis
atgtatagaacattgatgtctgcaaagttgcatagggctcgtgttactgaggcaaatctaaactacgtcggttccgtcacaatcgatgaagatctactcgatgccgttggtatgatggccaatgaaaaagttcaaattgtcaacaacaacaacggtgcaagattggagacctatatcattcctggtgaaagaggttcaggtgttgtttgtctgaacggtgctgctgcgaggttggtccaagtcggtgatgttgtcattatcgtttcttatgcaatgatgtcagaagaagaagctaagacccataagccaaaggttgctgttttgaacgaaagaaatgagattgaggaaatgttaggtcaagaaccagcaagaacaatcttataa

SEQ ID NO: 152 - DNA, 945 bp, Metallosphaera sedula
atgaccgaaaaggtctccgtcgtcggtgcaggcgtcatcggtgtcggttgggctaccttgttcgcttccaagggttactccgtctccttgtacaccgaaaagaaggaaaccttggacaagggtatcgaaaagttgcgtaactacgtccaagtcatgaagaacaactcccaaatcaccgaagacgtcaacaccgtcatctccagagtttcccctactaccaacttggacgaagccgttagaggtgcaaacttcgtcatcgaggctgtcatcgaagactacgacgctaagaagaagatcttcggttacttggactccgtcttggacaaggaagttatcttggcatcctccacctccggtttgttgatcaccgaagtccaaaaggctatgtccaagcacccagaaagagctgtcatcgcccacccatggaacccaccacacttgttgcctttggtcgaaatcgttccaggtgagaagacctccatggaagtcgttgagagaaccaagtccttgatggaaaagttggacagaatcgtcgtcgttttgaagaaggaaatcccaggtttcatcggtaacagattggcattcgctttgttcagagaagctgtctacttggttgacgagggtgtcgcaaccgtcgaggacatcgacaaggttatgactgccgctatcggcttgagatgggccttcatgggtccattcttgacctaccacttgggtggtggtgagggtggtttggaatacttcttcaacagaggtttcggttacggtgccaacgaatggatgcacaccttggctaagtacgacaagttcccatacaccggtgtcaccaaggccatccagcaaatgaaggaatactccttcatcaagggtaagaccttccaagagatctccaagtggagagacgaaaagttgttgaaggtctacaagttggtctgggaaaagtaa

SEQ ID NO: 153 - DNA, 1428 bp, Streptococcus mutans
atgaccaagcaatacaagaactacgttaacggtgaatggaagttgtccgagaacgaaatcaagatctacgagccagcatccggtgccgaattgggctccgttccagccatgtccaccgaagaagtcgactacgtttacgcatccgcaaagaaggctcaaccagcttggagagctttgtcctacatcgaaagagcagcttacttgcacaaggtcgcagacatcttgatgagagacaaggagaagatcggtgccgttttgtccaaggaagtcgcaaagggttacaagtccgcagtctccgaggttgttagaactgccgaaatcatcaactacgctgcagaagaaggtttgagaatggaaggtgaggtcttggaaggcggttccttcgaagcagcttccaagaagaagatcgcagtcgttcgtagagaaccagttggtttggttttggctatctccccattcaactacccagtcaacttggctggttccaagatcgcaccagcattgatcgcaggtaacgttatcgcattcaagcctccaacccaaggttccatctccggtttgttgttggccgaagctttcgctgaagcaggtttgccaggcggtgttttcaacaccatcaccggtagaggttccgaaatcggtgactacatcgttgaacaccaagcagtcaacttcatcaacttcaccggctccaccggcatcggtgaaagaatcggtaagatggcaggtatgagaccaatcatgttggaattaggcggtaaggactccgcaatcgttttggaggacgcagacttggagttgaccgcaaagaacatcatcgctggtgctttcggttactctggccaaagatgtaccgcagttaagagagttttggtcatggaatccgttgcagacgaattggtcgaaaagatcagagaaaaggttttggcattgaccatcggtaaccctgaagacgacgcagacatcacccctttgatcgacaccaagtccgcagactacgttgaaggtttgatcaacgacgcaaacgacaagggtgcagcagcattgaccgaaatcaagagagaaggtaacttgatctgcccaatcttgttcgacaaggttactaccgacatgcgtttggcgtgggaagaacctttcggtccagttttgccaatcatcagagttacctccgtcgaggaagcaatcgaaatctccaacaagtccgaatacggtttgcaagcatccatcttcaccaacgacttcccaagagcattcggcatcgcggaacaattggaagttggtaccgttcacatcaacaacaagacccaaagaggtaccgacaacttccctttcttgggtgcaaagaagtccggtgctggtatccaaggtgttaagtactccatcgaggcaatgactaccgtcaagtccgtcgttttcgacatcaagtaa

SEQ ID NO: 154 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAVLSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPGGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGAAALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 155 - protein, 496 aa, Pisum sativum
MAATGVLAEIIDGDVYKYYADGEWKKSTSGKSVAIINPTTRKPQYKVQACSQEEVNKVMDSAKSAQKSWAKTPLWKRAELLHKAAAILKEHKAAIAECLVKEIAKPAKDAVTEVVRSGDLVSYCAEEGVRILGEGKFLVSDSFPGNERTKYCLTSKIPLGVILAIPPFNYPVNLAVSKIAPALIAGNSIVLKPPTQGAVAALHMVHCFHLAGFPKGLISCVTGKGSEIGDFLTMHPGVNCISFTGGDTGIAISKKSGMIPLQMELGGKDACIVLEDADLDLVAANIIKGGFSYSGQRCTAVKVVLVMESVADALVEKVKVKVAKLSVGPPEDDSDITPVVSESSANFIEGLVNDAKEKGATFCQEYKREGNLIWPLLLDNVRPDMRIAWEEPFGPVLPVIRINSVEEGIHHCNASNFGLQGCVFTKDINKAIMISDAMESGTVQINSAPARGPDHFPFQGIKDSGIGSQGITNSINMMTKVKTTVINLPSPSYTMG

SEQ ID NO: 156 - protein, 496 aa, Triticum aestivum
MAGTGVFADVLDGEVYKYYADGEWRASASGKTVAIVNPTTRQTQYRVQACTQEEVNKVMDAAKVAQKSWARTPLWKRAELLHKAAAILKEHKTPIAESLVKEIAKPAKDAVSEVVRSGDLVSYTAEEGVRILGEGKLLVSDSFPGNERNKYCLSSKVPLGVVLAIPPFNYPVNLAVSKIGPALIAGNSLVLKPPTQGAVAALHMVHCFHLAGFPKGLISCVTGKGSEIGDFLTMHPGVNCISFTGGDTGIAISKKAGMVPLQMELGGKDACIVLEDADLDLVAANIVKGGFSYSGQRCTAVKVVLIMEAVADTVVEKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCVFTRDINKAIMISDAMESGTVQINSAPARGPDHFPFQGLKDSGIGSQGITNSINMMTKVKSTVINLPSPSYTMG

SEQ ID NO: 157 - protein, 496 aa, Arabidopsis thaliana
MAGTGLFAEILDGEVYKYYADGEWKTSSSGKSVAIMNPATRKTQYKVQACTQEEVNAVMELAKSAQKSWAKTPLWKRAELLHKAAAILKDNKAPMAESLVKEIAKPAKDSVTEVVRSGDLISYCAEEGVRILGEGKFLLSDSFPGNDRTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLDDADLDLVASNIIKGGFSYSGQRCTAVKVVLVMESVADELVEKVKAKVAKLTVGPPEENSDITAVVSESSANFIEGLVMDAKEKGATFCQEYKREGNLIWPLLLDNVRPDMRIAWEEPFGPVVPVLRINSVEEGINHCNASNFGLQGCVFTKDINKAILISDAMETGTVQINSAPARGPDHFPFQGLKDSGIGSQGVTNSINLMTKVKTTVINLPTPSYSMG

SEQ ID NO: 158 - protein, 476 aa, Streptococcus equinus
MTKQYKNYVNGEWKLSKEEIKIYAPATGEELGSVPAMSQEEVDYVYASAKAAQKAWRALSYVERAEYLHKAADILMRDAEKIGAVLSKEIAKGYKSAVGEVIRTAEIINYAAEEGVRLEGEVLEGGSFDPASKKKIAIVRREPVGLVLAISPFNYPINLAGSKIAPALISGNVVALKPPTQGSISGLLLAEAFAEAGLPAGVFNTITGRGSVIGDYIVEHEAVNYINFTGSTPVGEHIGHLAGMRPIMLELGGKDSAIILEDADLDLAAKNIVAGAYGYSGQRCTAVKRVLVMDSIADKLVEKVSALVNNLTVGMPEDNADITPLIDTKAADYVEGLIKDAQEKGAKEVISFKREGNLISPVLFDNVTTDMRLAWEEPFGPVLPFIRVNSVEEAIEISNKSEYGLQASVFTNNFPLAFKIAEQLEVGTVHINNKTQRGTDNFPFLGAKKSGAGVQGVKYSIEAMTTVKSTVFDIAK

SEQ ID NO: 159 - protein, 498 aa, Zea mays
MALAGTGVFAEILDGEVYRYYADGEWRTSASGKSVAIVNPTTRKTQYRVQACTQEEVNKAMDAAKVAQKAWARTPLWKRADVLHKAAAILKEHKAPIAECLVKEIAKPAKDAVSEVVRSGDLVSYTAEEGVRILGEGKLVVSDSFPGNERNKYCLSSKIPLGVVLAIPPFNYPANLAGSKIGPALIAGNALVLKPPTQGAVAALHMVHCFHLAGFPKGLISCVTGKGSEIGDFLTMHPGVNCISFTGGDTGIAISKKAGMVPLQMELGGKDACIVLEDADLDLVSANIVKGGFSYSGQRCTAVKVVLIMESIADAVVQKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCIFTRDINKAILISDAMETGTVQINSAPARGPDHFSFQGLKDSGIGSQGITNSINMMTKVKSTVINLPSPSYTMG

SEQ ID NO: 160 - protein, 233 aa, Scenedesmus vacuolatus
LAIPPFNYPVNLAVSKLAPALMAGNTVVLKPPSQGVVAGIHMIKCFQAAGLPAGTVNLVTGKGSEIGDFLTTHPAVNCISFTGGDTGIAISRKAGMVPLQMELGGKDACIVCSDADLDLAATHIIKGGFSYSGQRCTAVKVVLVMQDIADELVRKVHAGVQKLKVGRPEDNADITAVVSEGSANFIQGLVEDAKAKGATFLTDWKREGNLLWPVLLDNVTADMRIAWEEPFGP

SEQ ID NO: 161 - protein, 496 aa, Apium graveolens
MAGSGVYADIIEGDVFKYYSDGEWKKSSSGKSVAIINPTTRMTQFKVQACTQEEVNKAMETAKKVQKQWAKTPLWKRAELLHKAAAILKEHKAAIADCLVKEIAKPAKDSVTEVVRSGDLVSYCAEEGVRLLGEGKFLVSDSFPGNERTKYCLTSKIPLGVILAIPPFNYPVNLAVSKIGPALIAGNALVLKPPTQGAVACLHMVHCFHLAGFPKGLISCITGKGSEIGDFLTMHPGVNCISFTGGDTGIAISKKAGMVPLQMELGGKDACIVLEDADLDLVASNVIKGGFSYSGQRCTAIKVILVMQSVADTLVEKVNAKVAKLTVGPPEDNSDITPVVSESSANFIEGLVKDAKEKGATFCQEYKREGNLIWPLLLDNVKPDMRIAWEEPFGPILPVIRINSAEEGIHHCNASNFGLQGCVFTRDINKAMLISDAMESGTIQINSAPARGPDHFPFQGLKDSGIGSQGITNSINMMTKIKTTVINLPSPSYTMG

SEQ ID NO: 162 - protein, 496 aa, Nicotiana plumbaginifolia
MAGNGVFVDIIEGDVFKYYSEGEWKKSASGKSVAIINPTTRKTQYKVQACTQEEVNKVMEVAKTAQKSWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSLVLKPPTQGAVACLHMVHCFHLAGFPKGLISCVTGKGSEIGDFLTMHPGVHCISFTGGDTGVAISKKAGMIPLQMELGGKDACIVLEDADLDLAAGSIVKGGFSYSGQRCTAVKVVLVMESVADALVEKVNAKVAKLTVGPPEDDCDITPVVSESSANFIEGLVMDAKQKNATFCQQYKREGNLIWPLLLDNVRPDMRIAWEEPFGPVLPVIRINSVEEGIHHCNASNFGLQGCVFTKDINKAILISDAMETGTVQINSAPARGPDHFPFQGIKDSGIGSQGITNSINMMTKVKTTVINLPTPSYTMG

SEQ ID NO: 163 - DNA, 21 bp, Artificial Sequence
  Artificial DNA Primer
cggacatgtttttaaaggaag

SEQ ID NO: 164 - DNA, 20 bp, Artificial Sequence
  Artificial DNA Primer
gcatggtggtgcaagcgacg

SEQ ID NO: 165 - DNA, 20 bp, Artificial Sequence
  Artificial DNA Primer
atgggctgacctgaaaattc

SEQ ID NO: 166 - DNA, 20 bp, Artificial Sequence
  Artificial DNA Primer
cgctacgatacgctacgata

SEQ ID NO: 167 - DNA, 20 bp, Artificial Sequence
  Artificial DNA Primer
ctcccttccctgatagaagg

SEQ ID NO: 168 - DNA, 27 bp, Artificial Sequence
  Artificial DNA Primer
tttgatgataaatctgtattatagtcg

SEQ ID NO: 169 - DNA, 23 bp, Artificial Sequence
  Artificial DNA Primer
gctgaaaatatcattcagagcat

SEQ ID NO: 170 - DNA, 20 bp, Artificial Sequence
  Artificial DNA Primer
gatatgggcggtagagaaga

SEQ ID NO: 171 - DNA, 20 bp, Artificial Sequence
  Artificial DNA Primer
gctccttcaaaggcaacaca

SEQ ID NO: 172 - DNA, 26 bp, Artificial Sequence
  Artificial DNA Primer
gatgatatagttgatgctttccaaag

SEQ ID NO: 173 - DNA, 24 bp, Artificial Sequence
  Artificial DNA Primer
cgtgtctgttccttagcaagacac

SEQ ID NO: 174 - DNA, 20 bp, Artificial Sequence
  Artificial DNA Primer
aatcgacaatgtcggcacct

SEQ ID NO: 175 - DNA, 18 bp, Artificial Sequence
  Artificial DNA Primer
cgggtcttgcttttgttt

SEQ ID NO: 176 - DNA, 16 bp, Artificial Sequence
  Artificial DNA Primer
cccacaacttacggcg

SEQ ID NO: 177 - DNA, 20 bp, Artificial Sequence
  Artificial DNA Primer
agggtaccttagtacgaagg

SEQ ID NO: 178 - DNA, 20 bp, Artificial Sequence
  Artificial DNA Primer
ctattcttacgatgaaggcg

SEQ ID NO: 179 - DNA, 22 bp, Artificial Sequence
  Artificial DNA Primer
caaacccagtacacaatattgc

SEQ ID NO: 180 - DNA, 25 bp, Artificial Sequence
  Artificial DNA Primer
ccagtgatgacatttgatggttatc

SEQ ID NO: 181 - DNA, 21 bp, Artificial Sequence
  Artificial DNA Primer
cttcctttaaaaacatgtccg

SEQ ID NO: 182 - DNA, 25 bp, Artificial Sequence
  Artificial DNA Primer
tgaagaaaacagcaaactttttatg

SEQ ID NO: 183 - DNA, 21 bp, Artificial Sequence
  Artificial DNA Primer
gggaattacagaaaaactcgg

SEQ ID NO: 184 - DNA, 21 bp, Artificial Sequence
  Artificial DNA Primer
cgcatacacagatcatcaagg

SEQ ID NO: 185 - DNA, 1728 bp, Issatchenkia orientalis; identical to SEQ ID NO: 48

SEQ ID NO: 186 - protein, 575 aa, Issatchenkia orientalis; identical to SEQ ID NO: 49

SEQ ID NO: 187 - DNA, 1167 bp, Issatchenkia orientalis; identical to SEQ ID NO: 117

SEQ ID NO: 188 - protein, 388 aa, Issatchenkia orientalis; identical to SEQ ID NO: 118

SEQ ID NO: 189 - protein, 509 aa, Sulfolobus solfataricus
MEKTSVLIKSKELMEIYELKDGVPYFKTYLSGQWISGDEWQDVISPIDLNIIGKIPKLNWNQIDDTLEHIYRKGRWSIRDTPGEKRLDIYKKMASLLDKFKEDFVNVLMINNGKTKSAAEGEVKAAIERLLRADLDVKETRGDYVPGDWSSETLETEAVVRKEPVGVVLSIVPFNYPLFDTVNKIVYTTVIGNAIIIKPPSSTPLPILMLAKVMELASFPKDSFAIITIPGRDMNKVVGDKRIQAISLTGSTETGEEVVRNAGIKQFIMELGGGDPAIVLSDADLAWAAQRIAAGIISYTGQRCDSVKLVLVEEEVYDTLKDLLIKELTKSVKVGDPRDPLTTVGPVIDVKTVDEWEKAIKDAVEKGGKILFGGKRLGPTYIEPVLIEAPKETLKDMYFYNKEVFASAALLIKVKNIDEALEISNSRKYGLDAAIFGKDINKIRKLQRFLEVGAIYINDYPRHGIGYFPFGGRKDSGIGREGIGYTIQYVTAYKSIVYNYKGKGIWEYL

SEQ ID NO: 190 - protein, 482 aa, Clostridium acetobutylicum
MFENISSNGVYKNLFDGKWVESKTNKTIETHSPYDGSLIGKVQALSKEEVDEIFKSSRTAQKKWGETPINERARIMRKAADILDDNAEYIAKILSNEIAKDLKSSLSEVKRTADFIRFTANEGTHMEGEAINSDNFPGSKKDKLSLVERVPLGIVLAISPFNYPVNLSGSKVAPALIAGNSVVLKPSTTGAISALHLAEIFNAAGLPAGVLNTVTGKGSEIGDYLITHEEVNFINFTGSSAVGKHISKIAGMIPMVLELGGKDAAIVLEDANLETTAKSIVSGAYGYSGQRCTAVKRVLVMDKVADELVELVTKKVKELKVGNPFDDVTITPLIDNKAADYVQTLIDDAIEKGATLIVGNKRKENLMYPTLFDNVTADMRIAWEEPFGPVLPIIRVKSMDEAIELANRSEYGLQSAVFTENMHDAFYIANKLDVGTVQVNNKPERGPDHFPFLGTKSSGMGTQGIRYSIEAMTRHKSIVLNL

SEQ ID NO: 191 - DNA, 1497 bp, Zea mays
atggccttggctggtaccggtgttttcgcagaaatcttggactctgaggtctacagatactacgcagacggtgaatggagatcttctgcttctggtaagtccgttgcaatcgttaaccctactaccagaaagacccaatacagagtccaagcatgcacccaagaagaagttaacaaggctatggacgctgctaaggttgcccagaaggcatgggcaagaacccctttgtggaagagagcagaattgttgcacaaggctgctgctatcttgaaggagcacaaagccccaatcgctgaatgcttggttaaggaaatcgctaagccagccaaggacgctgttagtgaggtcgtcagatccggtgacttggtctcctacaccgcagaggaaggtgtcagaatcttgggtgaaggtaagttgttggtctccgactctttcccaggcaacgaaagaaacaagtactgcttgtcctccaagatcccattgggcgtcgttttggcaatcccacctttcaactacccagttaacttggccgtctccaagatcggtccagctttgatcgcaggtaacgctttggtcttgaagcctccaacccaaggtgctgtcgctgctttgcacatggtccactgtttccacttggcaggtttcccaaagggtttgatctcctgcgttaccggtaagggttccgaaatcggtgacttcttgaccatgcacccaggtgtcaactgtatctccttcaccggtggcgacaccggcatcgcaatctccaagaaggctggtatggtcccattgcaaatggaattgggtggtaaggacgcctgtatcgttttggaagacgcagacttggacttggtttccgcaaacatcgttaagggtggcttctcctactccggtcaaagatgtaccgcagtcaaggtcgttttgatcatggagtctatcgcagacgctgttgttcaaaaggttaacgctaagttggcaaagttgaaggtcggtccaccagaagacgactcagacatcaccccagttgttaccgaatcttctgccaacttcatcgaaggtttggttatggacgcaaaggaaaagggtgctaccttctgtcaggaatacagaagagaaggcaacttgatctggcctttgttgttggaccacgtcagaccagacatgcgtatcgcatgggaagaaccattcggtccagttttgccagtcatcagaatcaactctgttgaggaaggtatccaccactgtaacgcctccaacttcggtttgcagggctgtatcttcaccagagacatcaacaaggccatcttgatctccgacgctatggagaccggtaccgttcaaatcaactccgctccagctagaggtccagaccacttcccattccaaggtttgaaggactccggtatcggtagtcaaggtatcaccaactccatcaacatgatgaccaaggttaagagtaccgttatcaacttgccatccccatcctacaccatgggttag

SEQ ID NO: 192 - protein, 498 aa, Zea mays
MALAGTGVFAEILDSEVYRYYADGEWRSSASGKSVAIVNPTTRKTQYRVQACTQEEVNKAMDAAKVAQKAWARTPLWKRAELLHKAAAILKEHKAPIAECLVKEIAKPAKDAVSEVVRSGDLVSYTAEEGVRILGEGKLLVSDSFPGNERNKYCLSSKIPLGVVLAIPPFNYPVNLAVSKIGPALIAGNALVLKPPTQGAVAALHMVHCFHLAGFPKGLISCVTGKGSEIGDFLTMHPGVNCISFTGGDTGIAISKKAGMVPLQMELGGKDACIVLEDADLDLVSANIVKGGFSYSGQRCTAVKVVLIMESIADAVVQKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCIFTRDINKAILISDAMETGTVQINSAPARGPDHFPFQGLKDSGIGSQGITNSINMMTKVKSTVINLPSPSYTMG

SEQ ID NO: 193 - DNA, 1431 bp, Lactobacillus delbrueckii
atgaccgagcactacttgaactacgtcaacggcgaatggagagactctgcagacgctatcgaaatcttcgaaccagctaccggtaagtccttgggtaccgtcccagccatgtcccacgaagacgttgactacgttatgaactccgctaagaaggctttgcctgcttggagagcattgtcttacgtcgaaagagctgcatacttgcaaaaggctgcagacatcttgtaccgtgacgcagaaaagatcggttccaccttgtctaaggaaatcgcaaagggtttgaagtcttccatcggtgaagtcaccagaaccgctgaaatcgttgaatacaccgcaaaggttggtgttaccttggacggcgaagtcatggaaggtggtaacttcgaggcagcatccaagaacaagttggctgttgtcagaagagaaccagtcggtttggtcttggctatctccccattcaactacccagtcaacttggcaggttccaagatcgctccagcattgatgggtggtaacgttgttgcattcaagcctcctacccaaggttccatctctggtttgttgttggctaaggcattcgctgaggctggcttgccagcaggtgttttcaacaccatcaccggcagaggccgtgttatcggcgactacatcgtcgagcacccagcagtcaacttcatcaacttcaccggttcttctgcagtcggtaagaacatcggtaagttggctggtatgagaccaatcatgttggagttgggtggtaaggacgctgccatcgttttggaagacgcagacttggacttgaccgctaagaacatcgttgctggtgctttcggttactccggtcaaagatgtaccgctgttaagagagttttggttatggactccgttgcagacgaattggttgaaaaggtcaccgccttggctaaggacttgaccgttggtatccctgaagaagacgcagacatcaccccattgatcgacaccaagtccgcagactacgtccaaggcttgatcgaagaggctgctgaaaaaggcgcaaagccattgttcgacttcaagagagaaggtaacttgatctacccaatggtcatggaccaagttactaccgacatgagattggcctgggaagaaccatttggcccagttttgccattcatcagagttaagtccgcagacgaggctgttatgatcgccaacgaatctgaatacggtttgcaatcctctgtcttctccagaaacttcgagaaggctttcgctattgccggtaagttggaagttggtaccgttcacatcaacaacaagacccaaagaggtccagacaacttcccattcttgggtgttaagtcttccggtgctggtgtccagggcgttaagtactctatccaagctatgaccagagttaagtctgttgttttcaacatcgaagactaa

SEQ ID NO: 194 - protein, 476 aa, Lactobacillus delbrueckii
MTEHYLNYVNGEWRDSADAIEIFEPATGKSLGTVPAMSHEDVDYVMNSAKKALPAWRALSYVERAAYLQKAADILYRDAEKIGSTLSKEIAKGLKSSIGEVTRTAEIVEYTAKVGVTLDGEVMEGGNFEAASKNKLAVVRREPVGLVLAISPFNYPVNLAGSKIAPALMGGNVVAFKPPTQGSISGLLLAKAFAEAGLPAGVFNTITGRGRVIGDYIVEHPAVNFINFTGSSAVGKNIGKLAGMRPIMLELGGKDAAIVLEDADLDLTAKNIVAGAFGYSGQRCTAVKRVLVMDSVADELVEKVTALAKDLTVGIPEEDADITPLIDTKSADYVQGLIEEAAEKGAKPLFDFKREGNLIYPMVMDQVTTDMRLAWEEPFGPVLPFIRVKSADEAVMIANESEYGLQSSVFSRNFEKAFAIAGKLEVGTVHINNKTQRGPDNFPFLGVKSSGAGVQGVKYSIQAMTRVKSVVFNIED

What is claimed is:

1. A recombinant yeast cell, comprising: (1) an active 3-hydroxypropionic acid (3-HP) pathway that proceeds through a β-alanine intermediate, and (2) a heterologous polynucleotide encoding a non-phosphorylating NADP-dependent glyceraldehyde-3-phosphate dehydrogenase (GAPN), wherein the cell is capable of producing 3-HP.

2. The recombinant yeast cell of claim 1, wherein the cell comprises a heterologous polynucleotide encoding an aspartate 1-decarboxylase (ADC).

3. The recombinant yeast cell of claim 2, wherein the ADC has at least 80% sequence identity to the amino acid sequence of SEQ ID NO: 17, 18, 133, 135, 137, or 139.

4. The recombinant yeast cell of claim 2, wherein the ADC has an amino acid sequence comprising or consisting of SEQ ID NO: 17, 18, 133, 135, 137, or 139.

5. The recombinant yeast cell of claim 1, wherein the non-phosphorylating NADP-dependent glyceraldehyde-3-phosphate dehydrogenase (GAPN) has at least 95% sequence identity to the amino acid sequence of SEQ ID NO: 154, 155, 156, 157, 158, 159, 160, 161, 162, 189, 190, 192, or 194.

6. The recombinant yeast cell of claim 1, wherein the non-phosphorylating NADP-dependent glyceraldehyde-3-phosphate dehydrogenase (GAPN) has an amino acid sequence comprising or consisting of SEQ ID NO: 154, 155, 156, 157, 158, 159, 160, 161, 162, 189, 190, 192, or 194.

7. The recombinant yeast cell of any of claim 1, wherein the heterologous polynucleotide encoding the non-phosphorylating NADP-dependent glyceraldehyde-3-phosphate dehydrogenase (GAPN) comprises a promoter foreign to GAPN coding sequence.

8. The recombinant yeast cell of claim 1, wherein the cell is capable of producing a greater amount of 3-HP compared to the cell without the heterologous polynucleotide encoding the non-phosphorylating NADP-dependent glyceraldehyde-3-phosphate dehydrogenase (GAPN), when cultivated under identical conditions.

9. The recombinant yeast cell of claim 8, wherein the cell is capable of producing at least 10% more 3-HP compared to the cell without the heterologous polynucleotide encoding the non-phosphorylating NADP-dependent glyceraldehyde-3-phosphate dehydrogenase (GAPN), when cultivated under identical conditions.

10. The recombinant yeast cell of claim 1, wherein said cell further comprises a disruption to one or more endogenous genes encoding a pyruvate decarboxylase (PDC), alcohol dehydrogenase (ADH), glycerol 3-phosphate dehydrogenase (GPD), glycerol 3-phosphate phosphatase (GPP), aldehyde dehydrogenase (ALD), or phosphoenolpyruvate carboxykinase (PCK).

11. The recombinant yeast cell of claim 10, wherein said cell further comprises a disruption to an endogenous gene encoding a PDC.

12. The recombinant yeast cell of claim 10, wherein said cell further comprises a disruption to an endogenous gene encoding a GPD.

13. The recombinant yeast cell of claim 1, wherein the yeast cell belongs to a genus selected from *Issatchenkia, Candida, Kluyveromyces, Pichia, Schizosaccharomyces, Torulaspora, Zygosaccharomyces,* and *Saccharomyces.*

14. The recombinant yeast cell of claim 13, wherein the yeast cell belongs to a clade selected from the *I. orientalis/P fermentans* clade and the *Saccharomyces* clade.

15. The recombinant yeast cell of claim 13, wherein the yeast cell is selected from *I. orientalis, C. lambica,* and *S. bulderi.*

16. The recombinant yeast cell of claim 15, wherein the yeast cell is an *I. orientalis* CNB1 yeast cell.

17. The recombinant yeast cell of claim 16, wherein the yeast cell is unable to ferment pentose sugars.

18. The recombinant yeast cell of claim 1, wherein the cell is capable of growing at a pH of less than 4 in media containing 75 g/L or greater 3-HP.

19. The recombinant yeast cell of claim 1, wherein the cell is a 3-HP-resistant yeast cell.

20. The recombinant yeast cell of claim 1, wherein the cell has undergone mutation and/or selection, such that the mutated and/or selected cell possess a higher degree of resistance to 3-HP than a wild-type cell of the same species.

21. The recombinant yeast cell of claim 20, wherein the cell has undergone selection in the presence of lactic acid or 3-HP.

22. The recombinant yeast cell of claim 20, wherein the selection is chemostat selection.

23. A recombinant yeast cell, comprising (1) an active 3-HP pathway, and (2) a heterologous polynucleotide encoding a non-phosphorylating NADP-dependent glyceraldehyde-3-phosphate dehydrogenase (GAPN), wherein the GAPN has:
 (a) at least 95% sequence identity to the amino acid sequence of SEQ ID NO: 192; or
 (b) at least 95% sequence identity to the amino acid sequence of SEQ ID NO: 194; and
wherein the cell is capable of producing 3-HP.

24. The recombinant yeast cell of claim 23, wherein the non-phosphorylating NADP-dependent glyceraldehyde-3-phosphate dehydrogenase (GAPN) has an amino acid sequence comprising or consisting of SEQ ID NO: 192 or 194.

25. A method of producing 3-HP, comprising:
 (a) cultivating the recombinant yeast cell of claim 1 or claim 23 in a fermentable medium under suitable conditions to produce 3-HP; and
 (b) recovering the 3-HP.

26. The method of claim 25, wherein the fermentable medium comprises sucrose, glucose, and/or fructose.

27. The method of claim 25, wherein the yeast cell is an *I. orientalis* CNB1 yeast cell and the fermentable medium comprises less than 1% pentose sugars.

* * * * *